United States Patent
Gelfman et al.

(10) Patent No.: US 12,157,891 B2
(45) Date of Patent: Dec. 3, 2024

(54) TREATMENT OF UVEITIS WITH ENDOPLASMIC RETICULUM AMINOPEPTIDASE 1 (ERAP1) INHIBITORS

(71) Applicant: Regeneron Pharmaceuticals, Inc., Tarrytown, NY (US)

(72) Inventors: Sahar Gelfman, Tarrytown, NY (US); Ann Ligocki, Tarrytown, NY (US); Giovanni Coppola, Tarrytown, NY (US); Aris Baras, Tarrytown, NY (US); Arden Moscati, Tarrytown, NY (US); Eli A. Stahl, Tarrytown, NY (US); Carmelo Romano, Tarrytown, NY (US); Santiago Mendez Huergo, Tarrytown, NY (US); Jonathan Weyne, Tarrytown, NY (US); Tave Van Zyl, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

(21) Appl. No.: 18/046,291

(22) Filed: Oct. 13, 2022

(65) Prior Publication Data
US 2023/0250434 A1    Aug. 10, 2023

Related U.S. Application Data

(60) Provisional application No. 63/328,008, filed on Apr. 6, 2022, provisional application No. 63/255,597, filed on Oct. 14, 2021.

(51) Int. Cl.
| | |
|---|---|
| *C12N 15/113* | (2010.01) |
| *A61P 27/02* | (2006.01) |
| *C12N 9/22* | (2006.01) |
| *C12Q 1/37* | (2006.01) |

(52) U.S. Cl.
CPC .......... *C12N 15/1137* (2013.01); *A61P 27/02* (2018.01); *C12N 9/22* (2013.01); *C12Q 1/37* (2013.01); *C12N 2310/11* (2013.01); *C12N 2310/14* (2013.01); *G01N 2333/96425* (2013.01)

(58) Field of Classification Search
CPC .......... C12N 15/113; C12N 2310/141; C12N 2310/315; C12N 2310/321; C12N 2310/323; C12N 2310/3341; C12N 2310/346; C12N 2310/14; A61P 25/28; C07K 16/18
See application file for complete search history.

(56) References Cited

U.S. PATENT DOCUMENTS

| | | | | |
|---|---|---|---|---|
| 8,968,731 B2 * | 3/2015 | Wicks | ..................... | A61P 27/02 424/143.1 |
| 2013/0259876 A1 * | 10/2013 | Murphy | .................. | A61P 37/00 424/173.1 |
| 2013/0315933 A1 * | 11/2013 | Renner | .............. | C07K 16/2833 435/69.6 |

FOREIGN PATENT DOCUMENTS

| | | | | |
|---|---|---|---|---|
| WO | 2012047294 | 4/2012 | | |
| WO | WO-2014155278 A2 * | 10/2014 | .......... | C07K 16/244 |
| WO | 2021094763 | 5/2021 | | |
| WO | 2022026336 | 2/2022 | | |

OTHER PUBLICATIONS

Huang et al. "Genomewide Association Study of Acute Anterior Uveitis Identifies New Susceptibility Loci", Jun. 2020, IOVS, vol. 61 pp. 1-10. (Year: 2020).*
preventblindness.org [retrieved on Nov. 17, 2023]. Retrieved from the Internet: <URL: https://preventblindness.org/how-do-eye-doctors-treat-uveitis/> (Year: 2023).*
Plenge et al. "Validating therapeutic targets through human genetics", Published Jul. 2013, Nature Reviews Drug Discovery, vol. 12, p. 586. (Year: 2013).*
Kuiper et al., "Functionally distinct ERAP1 and ERAP2 are a hallmark of HLA-A29-(Birdshot) Uveitis", Human Molecular Genetics, 2018, 27(24), pp. 4333-4343.
Dimopoulou et al., "Variant in ERAP1 promoter region is associated with low expression in a patient with a Behcet-like MHC-I-opathy", Journal of Human Genetics, 2019, 65(3), pp. 325-335.
Doench et al., "Optimized sgRNA design to maximize activity and minimize off-target effects of CRISPR-Cas9", Nature Biotechnology, 2016, 34(2), pp. 184-191.
Akkoc et al., "Ankylosing Spondylitis: HLA-B*27-Positive Versus HLA-B*27-Negative Disease", Current Rheumatology Reports, 2017, 19(5), pp. 1-11.
Takeuchi et al., "Pathogenesis of Non-Infectious Uveitis Elucidated by Recent Genetic Findings", Frontiers in Immunology, 2021, 12, pp. 1-14.
Huang et al., "Genomewide Association Study of Acute Anterior Uveitis Indentifies New Susceptibility Loci", Investigative Opthalmology & Visual Science, 2020, 61(6), pp. 3-12.
Robinson et al., "The genetic association of acute anterior uveitis and their overlap with the genetics of ankylosing spondylitis", Genes and Immunity, 2016, 17(1), pp. 46-51.
Nossent et al., "The influence of ERAP1 gene variants on clinical phenotype in ankylosing spondylitis", Scandinavian Journal of Rheumatology, 2016, 45(6), pp. 474-479.

(Continued)

*Primary Examiner* — Brian Whiteman
*Assistant Examiner* — Stephanie L Sullivan
(74) *Attorney, Agent, or Firm* — Armstrong Teasdale LLP

(57) ABSTRACT

The present disclosure provides methods of treating subjects having uveitis, and methods of identifying subjects having an increased risk of developing uveitis.

9 Claims, 4 Drawing Sheets

Specification includes a Sequence Listing.

(56) References Cited

OTHER PUBLICATIONS

Robinson et al., "Genetic Dissection of Acute Anterior Uveitis Reveals Similarities and Differences in Associations Observed With Ankylosing Spondylitis: Genetics of Anterior Uveitits", Arthritis & Rheumatology, 2015, 67(1), pp. 140-151.

Kuiper et al., "HLA-A29 and Birdshot Uveitis: Further Down the Rabbit Hole", Frontiers in Immunology, 2020, 11, pp. 1-14.

\* cited by examiner

TREATMENT OF UVEITIS WITH ENDOPLASMIC RETICULUM AMINOPEPTIDASE 1 (ERAP1) INHIBITORS

REFERENCE TO SEQUENCE LISTING

This application includes a Sequence Listing submitted electronically as an XML file named 381203619SEQ, created on Oct. 11, 2022, with a size of 4,806 kilobytes. The Sequence Listing is incorporated herein by reference.

FIELD

The present disclosure relates generally to the treatment of subjects having uveitis, such as anterior uveitis, with Endoplasmic Reticulum Aminopeptidase 1 (ERAP1) inhibitors, and methods of identifying subjects having an increased risk of developing uveitis.

BACKGROUND

Anterior uveitis (AU) is an inflammation of the middle layer of the eye. This middle layer includes the iris (colored part of the eye) and adjacent tissue, known as the ciliary body. Anterior uveitis can result from a trauma to the eye, such as being hit in the eye or having a foreign body in the eye. It can also be associated with general health problems such as rheumatoid arthritis, syphilis, tuberculosis, sarcoid, viral (herpes simplex, herpes zoster, cytomegalovirus) or idiopathic, which is no obvious underlying cause. Acute anterior uveitis (AAU) involves inflammation of the iris and ciliary body of the eye. AAU occurs both in isolation and as an extra-articular feature of ankylosing spondylitis (AS). It is potentially sight threatening and can cause ophthalmological sequelae such as cataracts, posterior synechiae, and glaucoma. Uveitis accounts for about 10% of those individuals with severe vision impairment and blindness. The prevalence of anterior uveitis is approximately 0.1-0.3% (1-3:1,000). About 300,000-350,000 cases of uveitis occur in the United States. AAU occurs in 30-40% of individuals with AS and increases in frequency with disease duration such that the prevalence in individuals with AS for >50 years approaches 60%. AAU is known to be associated with HLA-B*27 independently of the association of this allele with AS (~50% of affected individuals are HLA-B*27 carriers).

Endoplasmic Reticulum Aminopeptidase 1 (ERAP1) is an aminopeptidase involved in trimming of HLA class I-binding precursors, a step required for the generation of most HLA class I-binding peptides so that they can be presented on MHC class I molecules. Peptide trimming is essential to customize longer precursor peptides to fit them to the correct length required for presentation on MHC class I molecules. ERAP1 acts as a monomer or as a heterodimer with ERAP2. ERAP1 strongly prefers substrates 9-16 residues long, rapidly degrades 13-mer to a 9-mer and then stops. ERAP1 preferentially hydrolyzes the residue Leu and peptides with a hydrophobic C-terminus, while it has weak activity toward peptides with charged C-terminus.

SUMMARY

The present disclosure provides methods of treating a subject having uveitis, the methods comprising administering an ERAP1 inhibitor to the subject.

The present disclosure also provides methods of treating a subject having iridocyclitis, the methods comprising administering an ERAP1 inhibitor to the subject.

The present disclosure also provides methods of treating a subject having iritis, the methods comprising administering an ERAP1 inhibitor to the subject.

The present disclosure also provides methods of treating a subject with a therapeutic agent that treats or inhibits uveitis, wherein the subject has uveitis, the methods comprising: determining whether the subject has an ERAP1 variant nucleic acid molecule by: obtaining or having obtained a biological sample from the subject; and performing or having performed a sequence analysis on the biological sample to determine if the subject has a genotype comprising the ERAP1 variant nucleic acid molecule; and administering or continuing to administer the therapeutic agent that treats or inhibits uveitis in a standard dosage amount to a subject that is ERAP1 reference, and/or administering an ERAP1 inhibitor to the subject; and administering or continuing to administer the therapeutic agent that treats or inhibits uveitis in an amount that is the same as or less than a standard dosage amount to a subject that is heterozygous for the ERAP1 variant nucleic acid molecule, and/or administering an ERAP1 inhibitor to the subject; wherein the presence of a genotype having the ERAP1 variant nucleic acid molecule indicates the subject has a decreased risk of developing uveitis.

The present disclosure also provides methods of identifying a subject having an increased risk of developing uveitis, the methods comprising: determining or having determined the presence or absence of an ERAP1 variant nucleic acid molecule in a biological sample obtained from the subject; wherein: when the subject is ERAP1 reference, then the subject has an increased risk of developing uveitis; and when the subject is heterozygous or homozygous for an ERAP1 variant nucleic acid molecule, then the subject has a decreased risk of developing uveitis.

The present disclosure also provides therapeutic agents that treat or inhibit uveitis for use in the treatment of uveitis in a subject identified as having: i) an ERAP1 variant genomic nucleic acid molecule, or the complement thereof, wherein the genomic nucleic acid molecule has a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; ii) an ERAP1 variant mRNA molecule, or the complement thereof, wherein the mRNA molecule has a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof; or iii) an ERAP1 variant cDNA molecule, or the complement thereof, wherein the cDNA molecule has a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

The present disclosure also provides ERAP1 inhibitors for use in the treatment of uveitis in a subject that: a) is reference for an ERAP1 genomic nucleic acid molecule, an ERAP1 mRNA molecule, or an ERAP1 cDNA molecule; or b) is heterozygous for: i) an ERAP1 variant genomic nucleic acid molecule, or the complement thereof, wherein the genomic nucleic acid molecule has a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; ii) an ERAP1 variant mRNA molecule, or the complement thereof, wherein the mRNA molecule has a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof; or iii) an ERAP1 variant cDNA molecule, or the complement thereof, wherein the cDNA molecule has a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

BRIEF DESCRIPTION OF THE DRAWINGS

The accompanying figures, which are incorporated in and constitute a part of this specification, illustrate several features of the present disclosure.

DESCRIPTION

Figure 1:
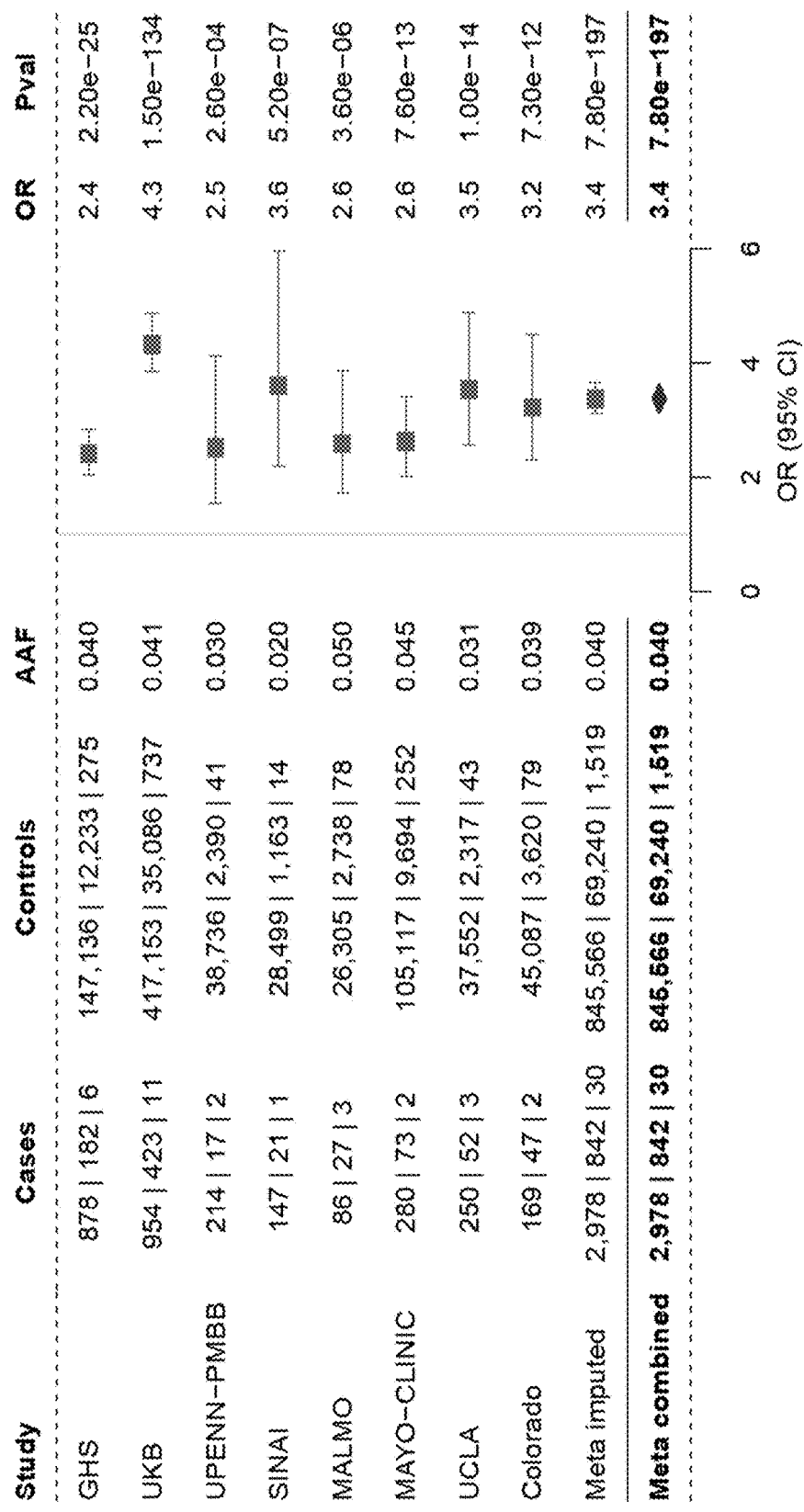
FIG. 1 shows Forest plots of the top single nucleotide polymorphisms (SNPs) in the HLA-B27 (Panel A) and ERAP1 (Panel B) loci.
Figure 1:
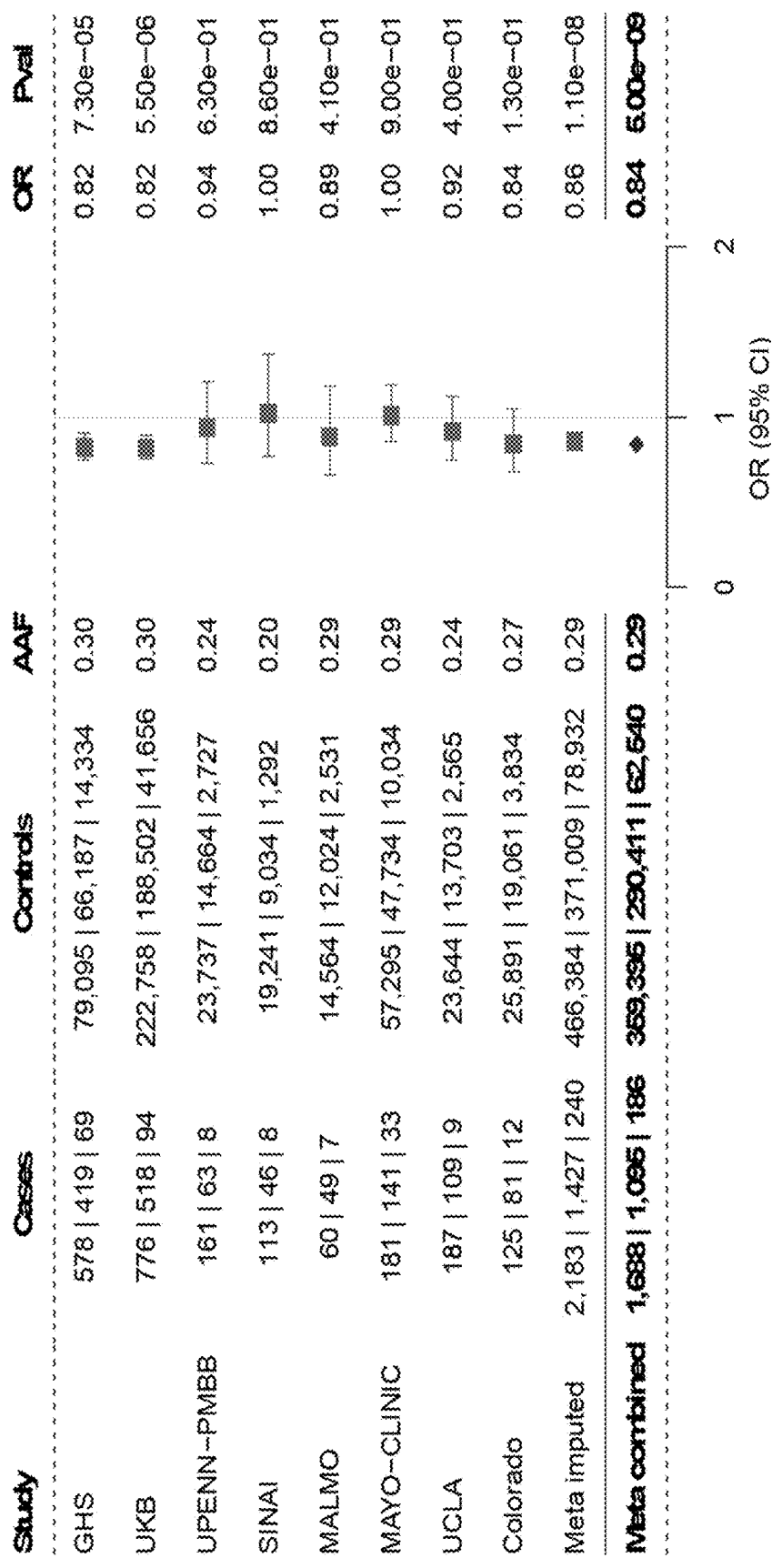

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is not intended that any method or aspect set forth herein be construed as requiring that its steps be performed in a specific order. Accordingly, where a method claim does not specifically state in the claims or descriptions that the steps are to be limited to a specific order, it is not intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or other tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

Variants in the ERAP1 gene that result in reduced expression of ERAP1 or that result in an ERAP1 predicted loss-of-function polypeptide associated with a decreased risk of developing uveitis, such as anterior uveitis, acute anterior uveitis, iridocyclitis, iritis, and pan-uveitis, in humans has been identified in accordance with the present disclosure. For example, a genetic alteration that changes the adenine at position 19,474 in the ERAP1 reference genomic nucleic acid molecule (see, SEQ ID NO:1) to a guanine, or changes the guanine at position 21,595 in the ERAP1 reference genomic nucleic acid molecule (see, SEQ ID NO:1) to an adenine, or changes the thymine at position 21,811 in the ERAP1 reference genomic nucleic acid molecule (see, SEQ ID NO:1) to a cytosine, or changes the cytosine at position 42,579 in the ERAP1 reference genomic nucleic acid molecule (see, SEQ ID NO:1) to a thymine has been observed to indicate that the subject having such an alteration may have a decreased risk of developing uveitis. Altogether, the genetic analyses described herein surprisingly indicate that the ERAP1 gene and, in particular, a variant in the ERAP1 gene, associates with a decreased risk of developing uveitis. In some embodiments, this association is independent of HLA-B*27. In some embodiments, this association is synergistic with HLA-B*27. Therefore, subjects that are ERAP1 reference that have an increased risk of developing uveitis, such as anterior uveitis, acute anterior uveitis, iridocyclitis, iritis, and pan-uveitis, may be treated such that the uveitis is prevented, the symptoms thereof are reduced, and/or development of symptoms is repressed. Accordingly, the present disclosure provides methods of leveraging the identification of such variants in subjects to identify or stratify risk in such subjects of developing uveitis, such as anterior uveitis, acute anterior uveitis, iridocyclitis, iritis, and pan-uveitis, or to diagnose subjects as having an increased risk of developing uveitis, such as anterior uveitis, acute anterior uveitis, iridocyclitis, iritis, and pan-uveitis, such that subjects at risk or subjects with active disease may be treated accordingly.

For purposes of the present disclosure, any particular subject can be categorized as having one of three ERAP1 genotypes: i) ERAP1 reference; ii) heterozygous for an ERAP1 variant nucleic acid molecule; or iii) homozygous for an ERAP1 variant nucleic acid molecule. A subject is ERAP1 reference when the subject does not have a copy of an ERAP1 variant nucleic acid molecule. A subject is heterozygous for an ERAP1 variant nucleic acid molecule when the subject has a single copy of an ERAP1 variant nucleic acid molecule. As used herein, an ERAP1 variant nucleic acid molecule is any ERAP1 nucleic acid molecule (such as, a genomic nucleic acid molecule, an mRNA molecule, or a cDNA molecule) encoding an ERAP1 polypeptide having a partial loss-of-function, a complete loss-of-function, a predicted partial loss-of-function, or a predicted complete loss-of-function, or any ERAP1 nucleic acid molecule that results in decreased expression of ERAP1 polypeptide. A subject who has an ERAP1 variant nucleic acid molecule is hypomorphic for ERAP1. The ERAP1 variant nucleic acid molecule encoding an ERAP1 predicted loss-of-function polypeptide can be any nucleic acid molecule encoding an ERAP1 Lys528Arg or Asp575Asn. In some embodiments, the ERAP1 variant nucleic acid molecule encodes ERAP1 Lys528Arg. In some embodiments, the ERAP1 variant nucleic acid molecule encodes ERAP1 Asp575Asn. A subject is homozygous for an ERAP1 variant nucleic acid molecule when the subject has two copies of an ERAP1 variant nucleic acid molecule.

For subjects that are genotyped or determined to be ERAP1 reference, such subjects have an increased risk of developing uveitis, such as anterior uveitis, acute anterior uveitis, iridocyclitis, iritis, and pan-uveitis. For subjects that are genotyped or determined to be either ERAP1 reference or heterozygous for an ERAP1 variant nucleic acid molecule, such subjects can be treated with an ERAP1 inhibitor.

In some embodiments, subjects that are genotyped or determined to be ERAP1 reference have an even higher risk of developing uveitis, such as anterior uveitis, acute anterior uveitis, iridocyclitis, iritis, and pan-uveitis, when they also have an increased number of HLA-B27 alleles (such as one or two HLA-B27 alleles compared to no HLA-27 alleles). In some embodiments, subjects that are genotyped or determined to be heterozygous for an ERAP1 variant nucleic acid molecule also have an even higher risk of developing uveitis, such as anterior uveitis, acute anterior uveitis, iridocyclitis, iritis, and pan-uveitis, when they also have an increased number of HLA-B27 alleles (such as one or two HLA-B27 alleles compared to no HLA-27 alleles). In some embodiments, the subject may have one HLA-B27 allele and one HLA-B40 allele (and also be ERAP1 reference or heterozygous for an ERAP1 variant nucleic acid molecule) and have an even higher risk of developing uveitis, such as anterior uveitis, acute anterior uveitis, iridocyclitis, iritis, and pan-uveitis (compared to a similar subject but having no HLA-B27 alleles).

In any of the embodiments described throughout the present disclosure, the ERAP1 variant nucleic acid molecule can be any ERAP1 nucleic acid molecule (such as, for example, genomic nucleic acid molecule, mRNA molecule, or cDNA molecule) encoding an ERAP1 polypeptide having a partial loss-of-function, a complete loss-of-function, a predicted partial loss-of-function, or a predicted complete loss-of-function, or any ERAP1 nucleic acid molecule that results in decreased expression of ERAP1 polypeptide. In any of the embodiments described herein, the ERAP1 variant nucleic acid molecule can be any nucleic acid molecule (such as, a genomic nucleic acid molecule, an mRNA molecule, or a cDNA molecule) that is a missense variant, a splice-site variant, a stop-gain variant, a start-loss variant, a stop-loss variant, a frameshift variant, an in-frame indel variant, or a variant that encodes a truncated ERAP1 polypeptide. For example, the ERAP1 variant nucleic acid molecule can be any nucleic acid molecule encoding ERAP1 Lys528Arg. In some embodiments, the ERAP1 variant nucleic acid molecule encodes ERAP1 Asp575Asn. In some embodiments, the ERAP1 variant nucleic acid molecule is not rs30187.

In any of the embodiments described throughout the present disclosure, the ERAP1 predicted loss-of-function polypeptide can be any ERAP1 polypeptide having a partial loss-of-function, a complete loss-of-function, a predicted partial loss-of-function, or a predicted complete loss-of-function. In any of the embodiments described throughout the present disclosure, the ERAP1 predicted loss-of-function polypeptide can be any of the ERAP1 polypeptides described herein including, for example, ERAP1 Lys528Arg or Asp575Asn. In some embodiments, the ERAP1 predicted loss-of-function polypeptide is ERAP1 Lys528Arg. In some embodiments, the ERAP1 predicted loss-of-function polypeptide is ERAP1 Asp575Asn.

In any of the embodiments described throughout the present disclosure, the uveitis is anterior uveitis, acute anterior uveitis, iridocyclitis, iritis, or pan-uveitis. In any of the embodiments described throughout the present disclosure, the uveitis is anterior uveitis. In any of the embodiments described throughout the present disclosure, the uveitis is acute anterior uveitis. In any of the embodiments described throughout the present disclosure, the anterior uveitis includes iridocyclitis. In any of the embodiments described throughout the present disclosure, the anterior uveitis includes iritis. In any of the embodiments described throughout the present disclosure, the uveitis is pan-uveitis. In any of the embodiments described throughout the present disclosure, the subject can have ankylosing spondylitis. In any of the embodiments described throughout the present disclosure, the subject does not have ankylosing spondylitis.

Symptoms of an anterior uveitis include, but are not limited to, severe redness in the eye, pain, dark floating spots in one's vision (so-called called "floaters"), light sensitivity, and or blurred vision.

The present disclosure provides methods of treating a subject having uveitis, the method comprising administering an ERAP1 inhibitor to the subject. In some embodiments, the uveitis is anterior uveitis. In some embodiments, the uveitis is acute anterior uveitis. In some embodiments, the uveitis is pan-uveitis.

The present disclosure also provides methods of treating a subject having iridocyclitis, the methods comprising administering an ERAP1 inhibitor to the subject.

The present disclosure also provides methods of treating a subject having iritis, the methods comprising administering an ERAP1 inhibitor to the subject.

In some embodiments, the ERAP1 inhibitor comprises an inhibitory nucleic acid molecule. In some embodiments, the inhibitory nucleic acid molecule comprises an antisense molecule, a small interfering RNA (siRNA) molecule, or a short hairpin RNA (shRNA) molecule. In some embodiments, the inhibitory nucleic acid molecule comprises an antisense molecule. In some embodiments, the inhibitory nucleic acid molecule comprises an siRNA molecule. In some embodiments, the inhibitory nucleic acid molecule comprises an shRNA molecule. Such inhibitory nucleic acid molecules can be designed to target any region of an ERAP1 nucleic acid molecule, such as an mRNA molecule. In some embodiments, the inhibitory nucleic acid molecule hybridizes to a sequence within an ERAP1 genomic nucleic acid molecule or mRNA molecule and decreases expression of the ERAP1 polypeptide in a cell in the subject. In some embodiments, the ERAP1 inhibitor comprises an antisense RNA that hybridizes to an ERAP1 genomic nucleic acid molecule or mRNA molecule and decreases expression of the ERAP1 polypeptide in a cell in the subject. In some embodiments, the ERAP1 inhibitor comprises an siRNA that hybridizes to an ERAP1 genomic nucleic acid molecule or mRNA molecule and decreases expression of the ERAP1 polypeptide in a cell in the subject. In some embodiments, the ERAP1 inhibitor comprises an shRNA that hybridizes to an ERAP1 genomic nucleic acid molecule or mRNA molecule and decreases expression of the ERAP1 polypeptide in a cell in the subject.

In some embodiments, the ERAP1 antisense nucleic acid molecules comprise or consist of any of the nucleotide sequences represented by SEQ ID NOs: 35-784. In some embodiments, the ERAP1 siRNA molecules comprise or consist of any of the nucleotide sequences (sense and antisense strands presented one after the other) represented by SEQ ID NOs: 785-2578 (e.g., the sense strand is, for example, SEQ ID NO: 785 and the corresponding antisense strand is SEQ ID NO: 786; the sense strand is, for example, SEQ ID NO: 787 and the corresponding antisense strand is SEQ ID NO: 788; etc.).

The inhibitory nucleic acid molecules can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ONH$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:
Sense: mN*mN*/i2FN/mN/i2FN/mN/i2FN/mN/i2FN/mN/ i2FN/mN/i2FN/mN/i2FN/mN/i2FN/*mN*/32FN/
Antisense: /52FN/*/i2FN/*mN/i2FN/mN/i2FN/mN/i2FN/ mN/i2FN/mN/i2FN/mN/i2FN/mN/i2FN/mN/i2FN/ mN*N*N wherein: "N" is the base; "2F" is a 2'-F modification; "m" is a 2'-O-methyl modification, "I" is an internal base; and "*" is a phosphorothioate backbone linkage.

In any of the embodiments described herein, the inhibitory nucleic acid molecules may be administered, for example, as one to two hour i.v. infusions or s.c. injections. In any of the embodiments described herein, the inhibitory nucleic acid molecules may be administered at dose levels that range from about 50 mg to about 900 mg, from about 100 mg to about 800 mg, from about 150 mg to about 700 mg, or from about 175 to about 640 mg (2.5 to 9.14 mg/kg; 92.5 to 338 mg/m$^2$-based on an assumption of a body weight of 70 kg and a conversion of mg/kg to mg/m$^2$ dose levels based on a mg/kg dose multiplier value of 37 for humans).

The present disclosure also provides vectors comprising any one or more of the inhibitory nucleic acid molecules. In some embodiments, the vectors comprise any one or more of the inhibitory nucleic acid molecules and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the ERAP1 inhibitor comprises a nuclease agent that induces one or more nicks or double-strand breaks at a recognition sequence(s) or a DNA-binding protein that binds to a recognition sequence within an ERAP1 genomic nucleic acid molecule. The recognition sequence can be located within a coding region of the ERAP1 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the ERAP1 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30 to about 36 bp for a zinc finger protein or ZFN pair, about 15 to about 18 bp for each ZFN, about 36 bp for a TALE protein or TALEN, and about 20 bp for a CRISPR/Cas guide RNA.

In some embodiments, CRISPR/Cas systems can be used to modify an ERAP1 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of ERAP1 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in an ERAP1 genomic nucleic acid molecule or it can be a nickase that creates a single-strand break in an ERAP1 genomic nucleic acid molecule. Additional examples of Cas proteins include, but are not limited to, Cas1, Cas1B, Cast, Cas3, Cas4, Cas5, Cas5e (CasD), Casio, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of an ERAP1 genomic nucleic acid molecules can be generated by contacting a cell with a Cas protein and one or more gRNAs that hybridize to one or more gRNA recognition sequences within a target genomic locus in the ERAP1 genomic nucleic acid molecule. For example, a gRNA recognition sequence can be located within a region of SEQ ID NO:1. The gRNA recognition sequence can also include or be proximate to a position corresponding to: position 19,474, position 21,595, position 21,811, or position 42,579. For example, the gRNA recognition sequence can be located about 1000, about 500, about 400, about 300, about 200, about 100, about 50, about 45, about 40, about 35, about 30, about 25, about 20, about 15, about 10, or about 5 nucleotides from a position corresponding to: position 19,474, position 21,595, position 21,811, or position 42,579. The gRNA recognition sequence can include or be proximate to the start codon or the stop codon of an ERAP1 genomic nucleic acid molecule. For example, the gRNA recognition sequence can be located about 10, about 20, about 30, about 40, about 50, about 100, about 200, about 300, about 400, about 500, or about 1,000 nucleotides from the start codon or the stop codon.

The gRNA recognition sequences within a target genomic locus in an ERAP1 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes a PAM. In addition, 5'-NGA-3' can be a highly efficient non-canonical PAM for human cells. Generally, the PAM is about 2 to about 6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10 base pairs, about 2 to about 5 base pairs, or 3 base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within an ERAP1 genomic nucleic acid molecule. An exemplary gRNA is a gRNA effective to direct a Cas enzyme to bind to or cleave an ERAP1 genomic nucleic acid molecule, wherein the gRNA comprises a DNA-targeting segment that hybridizes to a gRNA recognition sequence within the ERAP1 genomic nucleic acid molecule that includes or is proximate to a position corresponding to: position 19,474, position 21,595, position 21,811, or position 42,579. For example, a gRNA can be selected such that it hybridizes to a gRNA recognition sequence that is located about 5, about 10, about 15, about 20, about 25, about 30, about 35, about 40, about 45, about 50, about 100, about 200, about 300, about 400, about 500, or about 1,000 nucleotides from a position corresponding to: position 19,474, position 21,595, position 21,811, or position 42,579. Other exemplary gRNAs comprise a DNA-targeting segment that hybridizes to a gRNA recognition sequence present within an ERAP1 genomic nucleic acid molecule that includes or is proximate to the start codon or the stop codon. For example, a gRNA can be selected such that it hybridizes to a gRNA recognition sequence that is located about 5, about 10, about 15, about 20, about 25, about 30, about 35, about 40, about 45, about 50, about 100, about 200, about 300, about 400, about 500, or about 1,000 nucleotides from the start codon or located about 5, about 10, about 15, about 20, about 25, about 30, about 35, about 40, about 45, about 50, about 100, about 200, about 300, about 400, about 500, or about 1,000 nucleotides from the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs comprise 20 nucleotides.

Examples of suitable gRNA recognition sequences located within the ERAP1 reference gene are set forth in Table 1 as SEQ ID NOs:15-34.

TABLE 1

Guide RNA Recognition Sequences Near ERAP1 Variation(s)

| Strand | gRNA Recognition Sequence | SEQ ID NO: |
|---|---|---|
| + | GTGCAATTTGCTCCTGACGG | 15 |
| + | CACTTG CCATACTATCCCAC | 16 |
| + | TGTACGGGAGCCCGACAAGG | 17 |
| − | GAAGATGAGCACCTATCTGG | 18 |
| − | CCCTAATAACCATCACAGTG | 19 |
| + | AAGGCCATTCTAGCTGCAGT | 20 |
| − | AGATTATGCACTGGATGCTG | 21 |
| + | CAAAAATCGATGGACCATGT | 22 |
| + | TTTCCACAGGTGTAGACACA | 23 |
| − | TGAAAACCATGATGAACACT | 24 |
| + | CATAGCACCAGACTGAAAGT | 25 |
| + | TCAAGAGATCATAATGAACT | 26 |
| − | TTGTATTCTGAATATGCTAA | 27 |
| − | GAAGCAAGAGCACTACATGA | 28 |
| − | ACCTGGTCACTATGGAATGG | 29 |
| − | CAAAAGCACCTACAGAACCA | 30 |
| + | CTGTGTACGGGAGCCCGACA | 31 |
| − | ATACAAAAACGAGGACCTG | 32 |
| + | TCCACCATTCCATAGTGACC | 33 |
| − | CTATTACATTGTGCATTACG | 34 |

The Cas protein and the gRNA form a complex, and the Cas protein cleaves the target ERAP1 genomic nucleic acid molecule. The Cas protein can cleave the nucleic acid molecule at a site within or outside of the nucleic acid sequence present in the target ERAP1 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the ERAP1 genomic nucleic acid molecule to which a DNA-targeting segment of a gRNA will bind.

Such methods can result, for example, in an ERAP1 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the ERAP1 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the ERAP1 inhibitor comprises a small molecule degrader, a proteoloysis-targeting chimera, or an immunomodulatory agent. In some embodiments, the ERAP1 inhibitor comprises an anti-ERAP1 antibody. In some embodiments, the ERAP1 inhibitor is DG002 and DG013 (see, Zervoudi et al., Proc. Nat'l Acad. Sci. USA, 2013, 110, 19890-19895). In some embodiments, the ERAP1 inhibitor is a phosphinic dipeptide or tripeptide analog (see, Weglarz-Tomczak et al., Bioorg. Med. Chem. Lett., 2016, 26, 4122-4126). In some embodiments, the ERAP1 inhibitor is (N—(N-(2-(1H-indol-3-yl)ethyl) carbamimidoyl)-2,5-difluorobenzenesulfonamide), (1-(1-(4-acetylpiperazine-1-carbonyl) cyclohexyl)-3-(p-tolyl)urea), or (4-methoxy-3-(N-(2-(piperidin-1-yl)-5-(trifluoromethyl) phenyl)sulfamoyl)benzoic acid (see, Maben et al., J. Med. Chem., 2020, 63, 103-121). In some embodiments, the ERAP1 inhibitor is (4aR,5S,6R,8S,8aR)-5-(2-(Furan-3-yl) ethyl)-8-hydroxy-5,6,8a-trimethyl-3,4,4a,5,6,7,8,8a-octahydronaphthalene-1-carboxylic acid (see, Liddle et al., J. Med. Chem., 2020, 63, 3348-3358). In some embodiments, the ERAP1 inhibitor is DG013A or a phosphinic tripeptide or dipeptide or an aminophosphonic derivative, or 3,4-diaminobenzoic (DABA) derivative, or a derivative of thimerosal, (see, Georgiadis et al., Cur. Med. Chem., 2019, 26, 2715-2729). In some embodiments, the ERAP1 inhibitor is a benzofuran or 7-Benzofuran amide variation (see, Deddouche-Grass et al., ACS Med. Chem. Lett., 2021, 12, 1137-1142).

In some embodiments, the methods of treatment further comprise detecting the presence or absence of an ERAP1 variant nucleic acid molecule in a biological sample obtained from the subject. As used throughout the present disclosure, "an ERAP1 variant nucleic acid molecule" is any ERAP1 nucleic acid molecule (such as, for example, genomic nucleic acid molecule, mRNA molecule, or cDNA molecule) encoding an ERAP1 polypeptide having a partial loss-of-function, a complete loss-of-function, a predicted partial loss-of-function, or a predicted complete loss-of-function, or any ERAP1 nucleic acid molecule resulting in decreased expression of ERAP1 polypeptide.

The present disclosure also provides methods of treating a subject with a therapeutic agent that treats or inhibits uveitis. In some embodiments, the subject has uveitis, such as anterior uveitis. In some embodiments, the subject is at risk of developing uveitis, such as anterior uveitis. In some embodiments, the methods comprise determining whether the subject has an ERAP1 variant nucleic acid molecule by obtaining or having obtained a biological sample obtained from the subject, and performing or having performed a sequence analysis on the biological sample to determine if the subject has a genotype comprising the ERAP1 variant nucleic acid molecule. When the subject is ERAP1 reference, the therapeutic agent that treats or inhibits uveitis is administered or continued to be administered to the subject in a standard dosage amount, and/or an ERAP1 inhibitor is administered to the subject. When the subject is heterozygous for an ERAP1 variant nucleic acid molecule, the therapeutic agent that treats or inhibits uveitis is administered or continued to be administered to the subject in an amount that is the same as or less than a standard dosage amount, and/or an ERAP1 inhibitor is administered to the subject. The presence of a genotype having the ERAP1 variant nucleic acid molecule indicates the subject has a decreased risk of developing uveitis. In some embodiments, the subject is ERAP1 reference. In some embodiments, the subject is heterozygous for the ERAP1 variant nucleic acid molecule.

For subjects that are genotyped or determined to be either ERAP1 reference or heterozygous for the ERAP1 variant nucleic acid molecule, such subjects can be treated with an ERAP1 inhibitor, as described herein.

Detecting the presence or absence of an ERAP1 variant nucleic acid molecule in a biological sample obtained from a subject and/or determining whether a subject has an ERAP1 variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the ERAP1 variant nucleic acid molecule can be present within a cell obtained from the subject.

In some embodiments, when the subject is ERAP1 reference, the subject is also administered a therapeutic agent that treats or inhibits uveitis in a standard dosage amount. In some embodiments, when the subject is heterozygous for an ERAP1 variant nucleic acid molecule, the subject is also administered a therapeutic agent that treats or inhibits uveitis in a dosage amount that is the same as or less than a standard dosage amount.

In some embodiments, the treatment methods further comprise detecting the presence or absence of an ERAP1 predicted loss-of-function polypeptide in a biological sample obtained from the subject. In some embodiments, when the subject does not have an ERAP1 predicted loss-of-function polypeptide, the subject is also administered a therapeutic agent that treats or inhibits uveitis in a standard dosage amount. In some embodiments, when the subject has an ERAP1 predicted loss-of-function polypeptide, the subject is also administered a therapeutic agent that treats or inhibits uveitis in a dosage amount that is the same as or less than a standard dosage amount.

The present disclosure also provides methods of treating a subject with a therapeutic agent that treats or inhibits uveitis. In some embodiments, the subject has uveitis, such as anterior uveitis. In some embodiments, the subject is at risk of developing uveitis, such as anterior uveitis. In some embodiments, the methods comprise determining whether the subject has an ERAP1 predicted loss-of-function polypeptide by obtaining or having obtained a biological sample from the subject, and performing or having performed an assay on the biological sample to determine if the subject has an ERAP1 predicted loss-of-function polypeptide. When the subject does not have an ERAP1 predicted loss-of-function polypeptide, the therapeutic agent that treats or inhibits uveitis is administered or continued to be administered to the subject in a standard dosage amount, and/or an ERAP1 inhibitor is administered to the subject. When the subject has an ERAP1 predicted loss-of-function polypeptide, the therapeutic agent that treats or inhibits uveitis is administered or continued to be administered to the subject in an amount that is the same as or less than a standard dosage amount, and/or an ERAP1 inhibitor is administered to the subject. The presence of an ERAP1 predicted loss-of-function polypeptide indicates the subject has a decreased risk of developing uveitis. In some embodiments, the subject has an ERAP1 predicted loss-of-function polypeptide. In some embodiments, the subject does not have an ERAP1 predicted loss-of-function polypeptide.

Detecting the presence or absence of an ERAP1 predicted loss-of-function polypeptide in a biological sample obtained from a subject and/or determining whether a subject has an ERAP1 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the ERAP1 predicted loss-of-function polypeptide can be present within a cell obtained from the subject.

Examples of therapeutic agents that treat or inhibit uveitis, such as anterior uveitis, include, but are not limited to: ophthalmic steroids, such as prednisolone, prednisone, difluprednate, triamcinolone acetonide, fluorometholone, fluocinolone, or dexamethasone; immunosuppressants, such as azathioprine and cyclophosphamide; glucocorticoids, such as cortisone; and antirheumatics, such as adalimumab. Additional therapeutic agents that treat or inhibit uveitis include, but are not limited to, cyclopentolate, atropine, homatropine, corticotropin, gentamicin, corticotropin, loteprednol, tobramycin, atropine, sulfasalazine, hydrocortisone, neomycin, polymyxin b, bacitracin, and sulfacetamide sodium.

In some embodiments, the dose of the therapeutic agents that treat or inhibit uveitis can be reduced by about 10%, by about 20%, by about 30%, by about 40%, by about 50%, by about 60%, by about 70%, by about 80%, or by about 90% for subjects that are heterozygous for an ERAP1 variant nucleic acid molecule (i.e., less than the standard dosage amount) compared to subjects that are ERAP1 reference (who may receive a standard dosage amount). In some embodiments, the dose of the therapeutic agents that treat or inhibit uveitis can be reduced by about 10%, by about 20%, by about 30%, by about 40%, or by about 50%. In addition, the dose of therapeutic agents that treat or inhibit uveitis in subjects that are heterozygous for an ERAP1 variant nucleic acid molecule can be administered less frequently compared to subjects that are ERAP1 reference.

Administration of the therapeutic agents that treat or inhibit uveitis and/or ERAP1 inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more. In addition, the therapeutic agents that treat or inhibit uveitis and/or ERAP1 inhibitors can be administered sequentially or at the same time. In addition, the therapeutic agents that treat or inhibit uveitis and/or ERAP1 inhibitors can be administered in separate compositions or can be administered together in the same composition.

Administration of the therapeutic agents that treat or inhibit uveitis and/or ERAP1 inhibitors can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in uveitis, a decrease/reduction in the severity of uveitis (such as, for example, a reduction or inhibition of development of anterior uveitis), a decrease/reduction in symptoms and uveitis-related effects, delaying the onset of symptoms of uveitis-related effects, reducing the severity of symptoms of uveitis-related effects, reducing the severity of an acute episode, reducing the number of symptoms of uveitis-related effects, reducing the latency of symptoms of uveitis-related effects, an amelioration of symptoms of uveitis-related effects, reducing secondary symptoms, reducing secondary infections, preventing relapse to uveitis, decreasing the number or frequency of relapse episodes, increasing latency between symptomatic episodes, increasing time to sustained progression, expediting remission, inducing remission, augmenting remission, speeding recovery, or increasing efficacy of or decreasing resistance to alternative therapeutics, and/or an increased survival time of the affected host animal, following administration of any therapeutic agent or composition. A prophylactic effect may comprise a complete or partial avoidance/inhibition or a delay of uveitis development/progression (such as, for example, a complete or partial avoidance/inhibition or a delay), and an increased survival time of the affected host animal, following administration of a therapeutic protocol. Treatment of uveitis encompasses the treatment of subjects already diagnosed as having any form of uveitis at any clinical stage or manifestation, the delay of the onset or evolution or aggravation or deterioration of the symptoms or signs of uveitis, and/or preventing and/or reducing the severity of uveitis.

The present disclosure also provides methods of identifying a subject having an increased risk of developing uveitis, such as anterior uveitis. In some embodiments, the methods comprise determining or having determined the presence or absence of an ERAP1 variant nucleic acid molecule (such as a genomic nucleic acid molecule, mRNA molecule, and/or cDNA molecule) in a biological sample obtained from the subject. When the subject lacks an ERAP1 variant nucleic acid molecule (i.e., the subject is genotypically categorized as ERAP1 reference), then the subject has an increased risk of developing uveitis, such as anterior uveitis. When the subject has an ERAP1 variant nucleic acid molecule (i.e., the subject is heterozygous or homozygous for an ERAP1 variant nucleic acid molecule), then the subject has a decreased risk of developing uveitis compared to a subject that is ERAP1 reference.

Having a single copy of an ERAP1 variant nucleic acid molecule is more protective of a subject from developing uveitis than having no copies of an ERAP1 variant nucleic acid molecule. Without intending to be limited to any particular theory or mechanism of action, it is believed that a single copy of an ERAP1 variant nucleic acid molecule (i.e., heterozygous for an ERAP1 variant nucleic acid molecule) is protective of a subject from developing uveitis, such as anterior uveitis, and it is also believed that having two copies of an ERAP1 variant nucleic acid molecule (i.e., homozygous for an ERAP1 variant nucleic acid molecule) may be more protective of a subject from developing uveitis, such as anterior uveitis, relative to a subject with a single copy. Thus, in some embodiments, a single copy of an ERAP1 variant nucleic acid molecule may not be completely protective, but instead, may be partially or incompletely protective of a subject from developing uveitis, such as anterior uveitis. While not desiring to be bound by any particular theory, there may be additional factors or molecules involved in the development of uveitis that are still present in a subject having a single copy of an ERAP1 variant nucleic acid molecule, thus resulting in less than complete protection from the development of uveitis.

Detecting the presence or absence of an ERAP1 variant nucleic acid molecule in a biological sample obtained from a subject and/or determining whether a subject has an ERAP1 variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the ERAP1 variant nucleic acid molecule can be present within a cell obtained from the subject.

In some embodiments, when a subject is identified as having an increased risk of developing uveitis, the subject is further treated with a therapeutic agent that treats or inhibits uveitis and/or an ERAP1 inhibitor, as described herein. For example, when the subject is ERAP1 reference, and therefore has an increased risk for developing uveitis, the subject is administered an ERAP1 inhibitor. In some embodiments, such a subject is also administered a therapeutic agent that treats or inhibits uveitis. In some embodiments, when the subject is heterozygous for an ERAP1 variant nucleic acid molecule, the subject is administered the therapeutic agent that treats or inhibits uveitis in a dosage amount that is the same as or less than a standard dosage amount, and is also administered an ERAP1 inhibitor. In some embodiments, the subject is ERAP1 reference. In some embodiments, the subject is heterozygous for an ERAP1 variant nucleic acid molecule.

In any of the methods described herein, the methods can further comprise detecting the presence or absence of HLA-B27 and/or HLA-B40 in a biological sample obtained from the subject. In some embodiments, the subject is or is suspected of being HLA-B27$^+$. In some embodiments, the subject is or is suspected of being HLA-B40$^+$. In some embodiments, the method further comprises determining whether the subject has one or two copies of HLA-B27 and/or HLA-B40. In some embodiments, the subject has a single copy of HLA-B27 or HLA-B40. In some embodiments, the subject has two copies of HLA-B27 or HLA-B40. In some embodiments, the subject has a single copy of HLA-B27 and a single copy of HLA-B40. In some embodiments, the method further comprises administering to the subject an HLA-B27 inhibitor or an HLA-B40 inhibitor. In some embodiments, the HLA-B27 inhibitor or HLA-B40 inhibitor is an antibody. In some embodiments, the antibody is an anti-HLA-B27 antibody or an anti-HLA-B40 antibody. In some embodiments, the HLA-B27 inhibitor or HLA-B40 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B27 or an HLA-B40.

In some embodiments, the B27 antisense nucleic acid molecules comprise or consist of any of the nucleotide sequences represented by SEQ ID NOs: 2579-2923. In some embodiments, the B27 siRNA molecules comprise or consist of any of the nucleotide sequences (sense and antisense strands presented one after the other) represented by SEQ ID NOs: 2924-3661 (e.g., the sense strand is, for example, SEQ ID NO: 2924 and the corresponding antisense strand is SEQ ID NO: 2925; the sense strand is, for example, SEQ ID NO: 2926 and the corresponding antisense strand is SEQ ID NO: 2927; etc.).

HLA-class-I antibodies can be generated by numerous methodologies with different degrees of antigen/allele specificity attained and are reported to be used for in vitro assays. HLA-B27 antibodies can be generated by numerous methodologies. In addition, three commercially available antibodies for HLA-B27 flow cytometric screening include the monoclonal mouse anti-human ABC-m3, FD705, and GS145.2 which have been shown to each have differing levels of cross-reactivity to other HLA-B antigens/alleles (Levering et al., Cytometry B Clin. Cytom., 2003, 54, 28-38).

The present disclosure also provides methods of detecting the presence or absence of an ERAP1 variant genomic nucleic acid molecule in a biological sample obtained from a subject, and/or an ERAP1 variant mRNA molecule in a biological sample obtained from a subject, and/or an ERAP1 variant cDNA molecule produced from an mRNA molecule in a biological sample obtained from a subject. It is understood that gene sequences within a population and mRNA molecules encoded by such genes can vary due to polymorphisms such as SNPs. The sequences provided herein for the ERAP1 variant genomic nucleic acid molecules, ERAP1 variant mRNA molecules, and ERAP1 variant cDNA molecules are only exemplary sequences. Other sequences for the ERAP1 variant genomic nucleic acid molecules, variant mRNA molecules, and variant cDNA molecules are also possible.

The biological sample can be derived from any cell, tissue, or biological fluid from the subject. The biological sample may comprise any clinically relevant tissue such as, for example, a bone marrow sample, a tumor biopsy, a fine needle aspirate, or a sample of bodily fluid, such as blood, gingival crevicular fluid, plasma, serum, lymph, ascitic fluid, cystic fluid, or urine. In some embodiments, the biological sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any ERAP1 variant nucleic acid molecule, preliminary processing designed to isolate or enrich the biological sample for the ERAP1 variant nucleic acid molecule can be employed. A variety of techniques may be used for this purpose. When detecting the level of any ERAP1 variant mRNA molecule, different techniques can be used enrich the biological sample with mRNA molecules. Various methods to detect the presence or level of an mRNA molecule or the presence of a particular variant genomic DNA locus can be used.

The present disclosure also provides methods of detecting an ERAP1 variant nucleic acid molecule, or the complement thereof, in a subject. The methods comprise assaying a biological sample obtained from the subject to determine whether a nucleic acid molecule in the biological sample is an ERAP1 variant nucleic acid molecule.

In some embodiments, the ERAP1 variant nucleic acid molecule, or the complement thereof, is a genomic nucleic acid molecule having a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement.

In some embodiments, the ERAP1 variant nucleic acid molecule, or the complement thereof, is an mRNA molecule having a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof.

In some embodiments, the ERAP1 variant nucleic acid molecule, or the complement thereof, is a cDNA molecule produced from an mRNA molecule in the biological sample having a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

In some embodiments, the ERAP1 variant nucleic acid molecule has a nucleotide sequence comprising: a guanine at a position corresponding to position 19,474 according to SEQ ID NO:2, or the complement thereof, (for genomic nucleic acid molecules); a guanine at a position corresponding to position 1,841 according to SEQ ID NO:7, or the complement thereof, (for mRNA molecules); or a guanine at a position corresponding to position 1,841 according to SEQ ID NO:10, or the complement thereof, (for cDNA molecules obtained from mRNA molecules).

In some embodiments, the ERAP1 variant nucleic acid molecule has a nucleotide sequence comprising: an adenine at a position corresponding to position 21,595 according to SEQ ID NO:3, or the complement thereof, (for genomic nucleic acid molecules); an adenine at a position corresponding to position 1,981 according to SEQ ID NO:8, or the complement thereof, (for mRNA molecules); or an adenine at a position corresponding to position 1,981 according to SEQ ID NO:11, or the complement thereof, (for cDNA molecules obtained from mRNA molecules).

In some embodiments, the ERAP1 variant nucleic acid molecule has a nucleotide sequence comprising a cytosine at a position corresponding to position 21,811 according to SEQ ID NO:4, or the complement thereof.

In some embodiments, the ERAP1 variant nucleic acid molecule has a nucleotide sequence comprising a thymine at a position corresponding to position 42,579, or the complement thereof.

In some embodiments, the biological sample comprises a cell or cell lysate. Such methods can further comprise, for example, obtaining a biological sample from the subject comprising an ERAP1 genomic nucleic acid molecule or mRNA molecule, and if mRNA, optionally reverse transcribing the mRNA into cDNA. Such assays can comprise, for example determining the identity of these positions of the particular ERAP1 nucleic acid molecule. In some embodiments, the method is an in vitro method.

In some embodiments, the assay comprises sequencing at least a portion of the nucleotide sequence of the ERAP1 nucleic acid molecule, or the complement thereof, in the biological sample. In some embodiments, the assay comprises sequencing at least a portion of: the nucleotide sequence of the ERAP1 genomic nucleic acid molecule in the biological sample, wherein the sequenced portion comprises a position corresponding to position 19,474 according to SEQ ID NO:2, or the complement thereof; the nucleotide sequence of the ERAP1 mRNA molecule in the biological sample, wherein the sequenced portion comprises a position corresponding to position 1,841 according to SEQ ID NO:7, or the complement thereof; and/or the nucleotide sequence of the ERAP1 cDNA molecule produced from the mRNA in the biological sample, wherein the sequenced portion comprises a position corresponding to position 1,841 according to SEQ ID NO:10, or the complement thereof. When the sequenced portion of the ERAP1 nucleic acid molecule in the biological sample comprises: a guanine at a position corresponding to position 19,474 according to SEQ ID NO:2, or the complement thereof; a guanine at a position corresponding to position 1,841 according to SEQ ID NO:7, or the complement thereof; or a guanine at a position corresponding to position 1,841 according to SEQ ID NO:10, or the complement thereof; then the ERAP1 nucleic acid molecule in the biological sample is an ERAP1 variant nucleic acid molecule.

In some embodiments, the assay comprises sequencing at least a portion of: the nucleotide sequence of the ERAP1 genomic nucleic acid molecule in the biological sample, wherein the sequenced portion comprises a position corresponding to position 21,595 according to SEQ ID NO:3, or the complement thereof; the nucleotide sequence of the ERAP1 mRNA molecule in the biological sample, wherein the sequenced portion comprises a position corresponding to position 1,981 according to SEQ ID NO:8, or the complement thereof; and/or the nucleotide sequence of the ERAP1 cDNA molecule produced from the mRNA in the biological sample, wherein the sequenced portion comprises a position corresponding to position 1,981 according to SEQ ID NO:11, or the complement thereof. When the sequenced portion of the ERAP1 nucleic acid molecule in the biological sample comprises: an adenine at a position corresponding to position 21,595 according to SEQ ID NO:3, or the complement thereof; an adenine at a position corresponding to position 1,981 according to SEQ ID NO:8, or the complement thereof; or an adenine at a position corresponding to position 1,981 according to SEQ ID NO:11, or the complement thereof; then the ERAP1 nucleic acid molecule in the biological sample is an ERAP1 variant nucleic acid molecule.

In some embodiments, the assay comprises sequencing at least a portion of: the nucleotide sequence of the ERAP1 genomic nucleic acid molecule in the biological sample, wherein the sequenced portion comprises a position corresponding to position 21,811 according to SEQ ID NO:4, or the complement thereof; then the ERAP1 nucleic acid molecule in the biological sample is an ERAP1 variant nucleic acid molecule.

In some embodiments, the assay comprises sequencing at least a portion of: the nucleotide sequence of the ERAP1 genomic nucleic acid molecule in the biological sample, wherein the sequenced portion comprises a position corresponding to position 42,579 according to SEQ ID NO:5, or the complement thereof; then the ERAP1 nucleic acid molecule in the biological sample is an ERAP1 variant nucleic acid molecule.

In some embodiments, the assay comprises sequencing at least a portion of the nucleotide sequence of the ERAP1 genomic nucleic acid molecule, or the complement thereof, in the biological sample, wherein the sequenced portion comprises a position corresponding to: position 19,474 according to SEQ ID NO:2, or the complement thereof; position 21,595 according to SEQ ID NO:3, or the complement thereof; position 21,811 according to SEQ ID NO:4, or the complement thereof; or position 42,579 according to SEQ ID NO:5, or the complement thereof. When the sequenced portion of the ERAP1 genomic nucleic acid molecule in the biological sample comprises: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; then the ERAP1 genomic nucleic acid molecule in the biological sample is an ERAP1 variant genomic nucleic acid molecule.

In some embodiments, the assay comprises sequencing at least a portion of the nucleotide sequence of the ERAP1 mRNA molecule in the biological sample, wherein the sequenced portion comprises a position corresponding to: position 1,841 according to SEQ ID NO:7, or the complement thereof; position 1,981 according to SEQ ID NO:8, or the complement thereof; then the ERAP1 mRNA molecule in the biological sample is an ERAP1 variant mRNA molecule.

In some embodiments, the assay comprises sequencing at least a portion of the nucleotide sequence of the ERAP1 cDNA molecule produced from an mRNA molecule in the biological sample, wherein the sequenced portion comprises a position corresponding to: position 1,841 according to SEQ ID NO:10, or the complement thereof; position 1,981 according to SEQ ID NO:11, or the complement thereof; then the ERAP1 cDNA molecule produced from an mRNA molecule in the biological sample is an ERAP1 variant cDNA molecule.

In some embodiments, the assay comprises: a) contacting the biological sample with a primer hybridizing to a portion of the nucleotide sequence of the ERAP1: genomic nucleic acid molecule, or the complement thereof, that is proximate to a position corresponding to position 19,474 according to SEQ ID NO:2, or the complement thereof; mRNA molecule, or the complement thereof, that is proximate to a position corresponding to position 1,841 according to SEQ ID NO:7, or the complement thereof; and/or cDNA molecule, or the complement thereof, that is proximate to a position corresponding to position 1,841 according to SEQ ID NO:10, or the complement thereof; b) extending the primer at least through the position of the nucleotide sequence of the ERAP1: genomic nucleic acid molecule, or the complement thereof, corresponding to position 19,474 according to SEQ ID NO:2, or the complement thereof; mRNA molecule, or the complement thereof, corresponding to position 1,841 according to SEQ ID NO:7, or the complement thereof; and/or cDNA molecule, or the complement thereof, corresponding to position 1,841 according to SEQ ID NO:10, or the complement thereof; and c) determining whether the extension product of the primer comprises: a guanine at a position corresponding to position 19,474 according to SEQ ID NO:2, or the complement thereof; a guanine at a position corresponding to position 1,841 according to SEQ ID NO:7, or the complement thereof; and/or a guanine at a position corresponding to position 1,841 according to SEQ ID NO:10, or the complement thereof.

In some embodiments, the assay comprises: a) contacting the biological sample with a primer hybridizing to a portion of the nucleotide sequence of the ERAP1: genomic nucleic acid molecule, or the complement thereof, that is proximate to a position corresponding to position 21,595 according to SEQ ID NO:3, or the complement thereof; mRNA molecule, or the complement thereof, that is proximate to a position corresponding to position 1,981 according to SEQ ID NO:8, or the complement thereof; and/or cDNA molecule, or the complement thereof, that is proximate to a position corresponding to position 1,981 according to SEQ ID NO:11, or the complement thereof; b) extending the primer at least through the position of the nucleotide sequence of the ERAP1: genomic nucleic acid molecule, or the complement thereof, corresponding to position 21,595 according to SEQ ID NO:3, or the complement thereof; mRNA molecule, or the complement thereof, corresponding to position 1,981 according to SEQ ID NO:8, or the complement thereof; and/or cDNA molecule, or the complement thereof, corresponding to position 1,981 according to SEQ ID NO:11, or the complement thereof; and c) determining whether the extension product of the primer comprises: an adenine at a position corresponding to position 21,595 according to SEQ ID NO:3, or the complement thereof; an adenine at a position corresponding to position 1,981 according to SEQ ID NO:8, or the complement thereof; and/or an adenine at a position corresponding to position 1,981 according to SEQ ID NO:11, or the complement thereof.

In some embodiments, the assay comprises: a) contacting the biological sample with a primer hybridizing to a portion of the nucleotide sequence of the ERAP1 genomic nucleic acid molecule, or the complement thereof, that is proximate to a position corresponding to position 21,811 according to SEQ ID NO:4, or the complement thereof; b) extending the primer at least through the position of the nucleotide sequence of the ERAP1: genomic nucleic acid molecule, or the complement thereof, corresponding to position 21,811 according to SEQ ID NO:4, or the complement thereof; and c) determining whether the extension product of the primer comprises: a cytosine at a position corresponding to position 21,811 according to SEQ ID NO:4, or the complement thereof.

In some embodiments, the assay comprises: a) contacting the biological sample with a primer hybridizing to a portion of the nucleotide sequence of the ERAP1 genomic nucleic acid molecule, or the complement thereof, that is proximate to a position corresponding to position 42,579 according to SEQ ID NO:5, or the complement thereof; b) extending the primer at least through the position of the nucleotide sequence of the ERAP1: genomic nucleic acid molecule, or the complement thereof, corresponding to position 42,579 according to SEQ ID NO:5, or the complement thereof; and c) determining whether the extension product of the primer comprises: a thymine at a position corresponding to position 42,579 according to SEQ ID NO:5, or the complement thereof.

In some embodiments, the assay comprises: a) contacting the biological sample with a primer hybridizing to a portion of the nucleotide sequence of the ERAP1 genomic nucleic acid molecule, or the complement thereof, that is proximate to a position corresponding to: position 19,474 according to SEQ ID NO:2, or the complement thereof; position 21,595 according to SEQ ID NO:3, or the complement thereof; position 21,811 according to SEQ ID NO:4, or the complement thereof; or position 42,579 according to SEQ ID NO:5, or the complement thereof; b) extending the primer at least through the position of the nucleotide sequence of the ERAP1 genomic nucleic acid molecule, or the complement thereof, corresponding to: position 19,474 according to SEQ ID NO:2, or the complement thereof; position 21,595 according to SEQ ID NO:3, or the complement thereof; position 21,811 according to SEQ ID NO:4, or the complement thereof; or position 42,579 according to SEQ ID NO:5, or the complement thereof; and c) determining whether the extension product of the primer comprises: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof.

In some embodiments, the assay comprises: a) contacting the biological sample with a primer hybridizing to a portion of the nucleotide sequence of the ERAP1 mRNA molecule, or the complement thereof, that is proximate to a position corresponding to: position 1,841 according to SEQ ID NO:7, or the complement thereof; or position 1,981 according to SEQ ID NO:8, or the complement thereof; b) extending the primer at least through the position of the nucleotide sequence of the ERAP1 mRNA molecule, or the complement thereof, corresponding to: position 1,841 according to SEQ ID NO:7, or the complement thereof; or position 1,981 according to SEQ ID NO:8, or the complement thereof; and c) determining whether the extension product of the primer comprises: a guanine at a position corresponding to position 1,841 according to SEQ ID NO:7, or the complement thereof; or an adenine at a position corresponding to position 1,981 according to SEQ ID NO:8, or the complement thereof.

In some embodiments, the assay comprises: a) contacting the biological sample with a primer hybridizing to a portion of the nucleotide sequence of the ERAP1 cDNA molecule, or the complement thereof, that is proximate to a position corresponding to: position 1,841 according to SEQ ID NO:10, or the complement thereof; or position 1,981 according to SEQ ID NO:11, or the complement thereof; b) extending the primer at least through the position of the nucleotide sequence of the ERAP1 cDNA molecule, or the complement thereof, corresponding to: position 1,841 according to SEQ ID NO:10, or the complement thereof; or position 1,981 according to SEQ ID NO:11, or the complement thereof; and c) determining whether the extension product of the primer comprises: a guanine at a position corresponding to position 1,841 according to SEQ ID NO:10, or the complement thereof; or an adenine at a position corresponding to position 1,981 according to SEQ ID NO:11, or the complement thereof.

In some embodiments, the assay comprises sequencing the entire nucleic acid molecule. In some embodiments, only an ERAP1 genomic nucleic acid molecule is analyzed. In some embodiments, only an ERAP1 mRNA is analyzed. In some embodiments, only an ERAP1 cDNA obtained from an ERAP1 mRNA is analyzed.

In some embodiments, the assay comprises: a) amplifying at least a portion of the ERAP1 nucleic acid molecule, or the complement thereof, in the biological sample, wherein the amplified portion comprises: a guanine at a position corresponding to position 19,474 according to SEQ ID NO:2, or the complement thereof; a guanine at a position corresponding to position 1,841 according to SEQ ID NO:7, or the complement thereof; and/or a guanine at a position corresponding to position 1,841 according to SEQ ID NO:10, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a guanine at a position corresponding to position 19,474 according to SEQ ID NO:2, or the complement thereof; a guanine at a position corresponding to position 1,841 according to SEQ ID NO:7, or the complement thereof; and/or a guanine at a position corresponding to position 1,841 according to SEQ ID NO:10, or the complement thereof; and d) detecting the detectable label.

In some embodiments, the assay comprises: a) amplifying at least a portion of the ERAP1 nucleic acid molecule, or the complement thereof, in the biological sample, wherein the amplified portion comprises: an adenine at a position corresponding to position 21,595 according to SEQ ID NO:3, or the complement thereof; an adenine at a position corresponding to position 1,981 according to SEQ ID NO:8, or the complement thereof; and/or an adenine at a position corresponding to position 1,981 according to SEQ ID NO:11, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: an adenine at a position corresponding to position 21,595 according to SEQ ID NO:3, or the complement thereof; an adenine at a position corresponding to position 1,981 according to SEQ ID NO:8, or the complement thereof; and/or an adenine at a position corresponding to position 1,981 according to SEQ ID NO:11, or the complement thereof; and d) detecting the detectable label.

In some embodiments, the assay comprises: a) amplifying at least a portion of the ERAP1 nucleic acid molecule, or the complement thereof, in the biological sample, wherein the amplified portion comprises: a cytosine at a position corresponding to position 21,811 according to SEQ ID NO:4, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a cytosine at a position corresponding to position 21,811 according to SEQ ID NO:4, or the complement thereof; and d) detecting the detectable label.

In some embodiments, the assay comprises: a) amplifying at least a portion of the ERAP1 nucleic acid molecule, or the complement thereof, in the biological sample, wherein the amplified portion comprises: a thymine at a position corresponding to position 42,579 according to SEQ ID NO:5, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a thymine at a position corresponding to position 42,579 according to SEQ ID NO:5, or the complement thereof; and d) detecting the detectable label.

In some embodiments, the assay comprises: a) amplifying at least a portion of the ERAP1 genomic nucleic acid molecule, or the complement thereof, in the biological sample, wherein the portion comprises: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; and d) detecting the detectable label.

In some embodiments, the assay comprises: a) amplifying at least a portion of the ERAP1 mRNA molecule, or the complement thereof, in the biological sample, wherein the portion comprises: a guanine at a position corresponding to position 1,841 according to SEQ ID NO:7, or the complement thereof; or an adenine at a position corresponding to position 1,981 according to SEQ ID NO:8, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a guanine at a position corresponding to position 1,841 according to SEQ ID NO:7, or the complement thereof; or an adenine at a position corresponding to position 1,981 according to SEQ ID NO:8, or the complement thereof; and d) detecting the detectable label.

In some embodiments, the assay comprises: a) amplifying at least a portion of the ERAP1 cDNA molecule, or the complement thereof, produced from an mRNA molecule in the biological sample, wherein the portion comprises: a guanine at a position corresponding to position 1,841 according to SEQ ID NO:10, or the complement thereof; or an adenine at a position corresponding to position 1,981 according to SEQ ID NO:11, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: a guanine at a position corresponding to position 1,841 according to SEQ ID NO:10, or the complement thereof; or an adenine at a position corresponding to position 1,981 according to SEQ ID NO:11, or the complement thereof; and d) detecting the detectable label.

In some embodiments, the nucleic acid molecule in the sample is mRNA and the mRNA is reverse-transcribed into cDNA prior to the amplifying step.

In some embodiments, the assay comprises: contacting the ERAP1 nucleic acid molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 nucleic acid molecule, or the complement thereof, comprising: a guanine at a position corresponding to position 19,474 according to SEQ ID NO:2, or the complement thereof; a guanine at a position corresponding to position 1,841 according to SEQ ID NO:7, or the complement thereof; and/or a guanine at a position corresponding to position 1,841 according to SEQ ID NO:10, or the complement thereof; and detecting the detectable label.

In some embodiments, the assay comprises: contacting the ERAP1 nucleic acid molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 nucleic acid molecule, or the complement thereof, comprising: an adenine at a position corresponding to position 21,595 according to SEQ ID NO:3, or the complement thereof; an adenine at a position corresponding to position 1,981 according to SEQ ID NO:8, or the complement thereof; and/or an adenine at a position corresponding to position 1,981 according to SEQ ID NO:11, or the complement thereof; and detecting the detectable label.

In some embodiments, the assay comprises: contacting the ERAP1 nucleic acid molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 nucleic acid molecule, or the complement thereof, comprising a cytosine at a position corresponding to position 21,811 according to SEQ ID NO:4, or the complement thereof; and detecting the detectable label.

In some embodiments, the assay comprises: contacting the ERAP1 nucleic acid molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 nucleic acid molecule, or the complement thereof, comprising a thymine at a position corresponding to position 42,579 according to SEQ ID NO:5, or the complement thereof; and detecting the detectable label.

In some embodiments, the assay comprises: contacting the ERAP1 genomic nucleic acid molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 genomic nucleic acid molecule, or the complement thereof, comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof; and detecting the detectable label.

In some embodiments, the assay comprises: contacting the ERAP1 mRNA molecule, or the complement thereof, in the biological sample with an alteration-specific probe comprising a detectable label, wherein the alteration-specific probe comprises a nucleotide sequence which hybridizes under stringent conditions to the nucleotide sequence of the ERAP1 mRNA molecule, or the complement thereof, comprising: a guanine at a position corresponding to position 1,841 according to SEQ ID NO:7, or the complement thereof; or an adenine at a position corresponding to position 1,981 according to SEQ ID NO:8, or the complement thereof; and detecting the detectable label.

In some embodiments, the assay comprises: contacting the ERAP1 cDNA molecule, or the complement thereof, produced from an mRNA molecule in the biological sample with an alteration-specific probe comprising a detectable label, wherein the alteration-specific probe comprises a nucleotide sequence which hybridizes under stringent conditions to the nucleotide sequence of the ERAP1 cDNA molecule, or the complement thereof, comprising: a guanine at a position corresponding to position 1,841 according to SEQ ID NO:10, or the complement thereof; or an adenine at a position corresponding to position 1,981 according to SEQ ID NO:11, or the complement thereof; and detecting the detectable label.

In some embodiments, the ERAP1 nucleic acid molecule is present within a cell obtained from the subject.

Alteration-specific polymerase chain reaction techniques can be used to detect mutations such as SNPs in a nucleotide sequence. Alteration-specific primers can be used because the DNA polymerase will not extend when a mismatch with the template is present.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising an ERAP1 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether an ERAP1 nucleic acid molecule (genomic nucleic acid molecule, mRNA molecule, or cDNA molecule), or complement thereof, within a biological sample comprises a nucleotide sequence comprising a guanine at a position corresponding to position 19,474 according to SEQ ID NO:2 (genomic nucleic acid molecule), a guanine at a position corresponding to position 1,841 according to SEQ ID NO:7 (mRNA molecule), or a guanine at a position corresponding to position 1,841 according to SEQ ID NO:10 (cDNA molecule), the biological sample can be subjected to an amplification method using a primer pair that includes a first primer derived from the 5' flanking sequence adjacent to a guanine at a position corresponding to position 19,474 according to SEQ ID NO:2, a guanine at a position corresponding to position 1,841 according to SEQ ID NO:7, or a guanine at a position corresponding to position 1,841 according to SEQ ID NO:10, and a second primer derived from the 3' flanking sequence adjacent to a guanine at a position corresponding to position 19,474 according to SEQ ID NO:2, a guanine at a position corresponding to position 1,841 according to SEQ ID NO:7, or a guanine at a position corresponding to position 1,841 according to SEQ ID NO:10 to produce an amplicon that is indicative of the presence of the SNP at positions encoding a guanine at a position corresponding to position 19,474 according to SEQ ID NO:2, a guanine at a position corresponding to position 1,841 according to SEQ ID NO:7, or a guanine at a position corresponding to position 1,841 according to SEQ ID NO:10. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a guanine at a position corresponding to position 19,474 according to SEQ ID NO:2, a guanine at a position corresponding to position 1,841 according to SEQ ID NO:7, or a guanine at a position corresponding to position 1,841 according to SEQ ID NO:10, and at least 1, 2, 3, 4, 5, 6, 7, 8, 9, 10, or more nucleotides on each side of positions comprising a guanine at a position corresponding to position 19,474 according to SEQ ID NO:2, a guanine at a position corresponding to position 1,841 according to SEQ ID NO:7, or a guanine at a position corresponding to position 1,841 according to SEQ ID NO:10.

In some embodiments, to determine whether an ERAP1 nucleic acid molecule (genomic nucleic acid molecule, mRNA molecule, or cDNA molecule), or complement thereof, within a biological sample comprises a nucleotide sequence comprising an adenine at a position corresponding to position 21,595 according to SEQ ID NO:3 (genomic nucleic acid molecule), an adenine at a position corresponding to position 1,981 according to SEQ ID NO:8 (mRNA molecule), or an adenine at a position corresponding to position 1,981 according to SEQ ID NO:11 (cDNA molecule), the biological sample can be subjected to an amplification method using a primer pair that includes a first primer derived from the 5' flanking sequence adjacent to an adenine at a position corresponding to position 21,595 according to SEQ ID NO:3, an adenine at a position corresponding to position 1,981 according to SEQ ID NO:8, or an adenine at a position corresponding to position 1,981 according to SEQ ID NO:11, and a second primer derived from the 3' flanking sequence adjacent to an adenine at a position corresponding to position 21,595 according to SEQ ID NO:3, an adenine at a position corresponding to position 1,981 according to SEQ ID NO:8, or an adenine at a position corresponding to position 1,981 according to SEQ ID NO:11 to produce an amplicon that is indicative of the presence of the SNP at positions encoding an adenine at a position corresponding to position 21,595 according to SEQ ID NO:3, an adenine at a position corresponding to position 1,981 according to SEQ ID NO:8, or an adenine at a position corresponding to position 1,981 according to SEQ ID NO:11. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 21,595 according to SEQ ID NO:3, an adenine at a position corresponding to position 1,981 according to SEQ ID NO:8, or an adenine at a position corresponding to position 1,981 according to SEQ ID NO:11, and at least 1, 2, 3, 4, 5, 6, 7, 8, 9, 10, or more nucleotides on each side of positions comprising an adenine at a position corresponding to position 21,595 according to SEQ ID NO:3, an adenine at a position corresponding to position 1,981 according to SEQ ID NO:8, or an adenine at a position corresponding to position 1,981 according to SEQ ID NO:11.

In some embodiments, to determine whether an ERAP1 nucleic acid molecule (genomic nucleic acid molecule, mRNA molecule, or cDNA molecule), or complement thereof, within a biological sample comprises a nucleotide sequence comprising a cytosine at a position corresponding to position 21,811 according to SEQ ID NO:4 (genomic nucleic acid molecule), the biological sample can be subjected to an amplification method using a primer pair that includes a first primer derived from the 5' flanking sequence adjacent to a cytosine at a position corresponding to position 21,811 according to SEQ ID NO:4, and a second primer derived from the 3' flanking sequence adjacent to a cytosine at a position corresponding to position 21,811 according to SEQ ID NO:4 to produce an amplicon that is indicative of the presence of the SNP at positions encoding a cytosine at a position corresponding to position 21,811 according to SEQ ID NO:4. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a cytosine at a position corresponding to position 21,811 according to SEQ ID NO:4, and at least 1, 2, 3, 4, 5, 6, 7, 8, 9, 10, or more nucleotides on each side of positions comprising a cytosine at a position corresponding to position 21,811 according to SEQ ID NO:4.

In some embodiments, to determine whether an ERAP1 nucleic acid molecule (genomic nucleic acid molecule, mRNA molecule, or cDNA molecule), or complement thereof, within a biological sample comprises a nucleotide sequence comprising a thymine at a position corresponding to position 42,579 according to SEQ ID NO:5 (genomic nucleic acid molecule), the biological sample can be subjected to an amplification method using a primer pair that includes a first primer derived from the 5' flanking sequence adjacent to a thymine at a position corresponding to position 42,579 according to SEQ ID NO:5, and a second primer derived from the 3' flanking sequence adjacent to a thymine at a position corresponding to position 42,579 according to SEQ ID NO:5, to produce an amplicon that is indicative of the presence of the SNP at positions encoding a thymine at a position corresponding to position 42,579 according to SEQ ID NO:5. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a thymine at a position corresponding to position 42,579 according to SEQ ID NO:5, and at least 1, 2, 3, 4, 5, 6, 7, 8, 9, 10, or more nucleotides on each side of positions comprising a thymine at a position corresponding to position 42,579 according to SEQ ID NO:5.

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in Current Protocols in Molecular Biology, John Wiley & Sons, N.Y. (1989), 6.3.1-6.3.6. Typically, stringent conditions for hybridization and detection will be those in which the salt concentration is less than about 1.5 M Na$^+$ ion, typically about 0.01 to 1.0 M Na$^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of an ERAP1 predicted loss-of-function polypeptide comprising performing an assay on a biological sample obtained from the subject to determine whether an ERAP1 polypeptide in the biological sample contains one or more variations that causes the polypeptide to have a loss-of-function (partial or complete) or predicted loss-of-function (partial or complete). The ERAP1 predicted loss-of-function polypeptide can be any of the ERAP1 predicted loss-of-function polypeptide described herein. In some embodiments, the methods detect the presence of ERAP1 Lys528Arg or Asp575Asn. In some embodiments, the methods detect the presence of ERAP1 Lys528Arg. In some embodiments, the methods detect the presence of ERAP1 Asp575Asn.

In some embodiments, the methods comprise performing an assay on a biological sample obtained from a subject to determine whether an ERAP1 polypeptide in the biological sample comprises: an arginine at a position corresponding to position 528 according to SEQ ID NO:13 or an asparagine at a position corresponding to position 575 according to SEQ ID NO:14.

In some embodiments, the assay comprises sequencing at least a portion of the ERAP1 polypeptide that comprises a position corresponding to: position 528 according to SEQ ID NO:13 or SEQ ID NO:12, or position 575 according to SEQ ID NO:14 or SEQ ID NO:12.

In some embodiments, the assay is an immunoassay for detecting the presence of a ERAP1 polypeptide that comprises a position corresponding to: position 528 according to SEQ ID NO:13 or SEQ ID NO:12, or position 575 according to SEQ ID NO:14 or SEQ ID NO:12.

In some embodiments, when the subject does not have an ERAP1 predicted loss-of-function polypeptide, the subject has an increased risk of developing uveitis. In some embodiments, when the subject has an ERAP1 predicted loss-of-function polypeptide, the subject has a decreased risk of developing uveitis.

The present disclosure also provides isolated nucleic acid molecules that hybridize to ERAP1 variant genomic nucleic acid molecules, ERAP1 variant mRNA molecules, and/or ERAP1 variant cDNA molecules (such as any of the genomic variant nucleic acid molecules, mRNA variant molecules, and cDNA variant molecules disclosed herein). In some embodiments, such isolated nucleic acid molecules hybridize to ERAP1 variant nucleic acid molecules under stringent conditions. Such nucleic acid molecules can be used, for example, as probes, primers, alteration-specific probes, or alteration-specific primers as described or exemplified herein.

In some embodiments, the isolated nucleic acid molecules hybridize to a portion of the ERAP1 nucleic acid molecule that includes a position corresponding to: position 19,474 according to SEQ ID NO:2, position 1,841 according to SEQ ID NO:7, or position 1,841 according to SEQ ID NO:10. In some embodiments, the isolated nucleic acid molecules hybridize to a portion of the ERAP1 nucleic acid molecule that includes a position corresponding to: position 21,595 according to SEQ ID NO:3, position 1,981 according to SEQ ID NO:8, or position 1,981 according to SEQ ID NO:11. In some embodiments, the isolated nucleic acid molecules hybridize to a portion of the ERAP1 nucleic acid molecule that includes a position corresponding: to position 21,811 according to SEQ ID NO:4. In some embodiments, the isolated nucleic acid molecules hybridize to a portion of the ERAP1 nucleic acid molecule that includes a position corresponding to: position 42,579 according to SEQ ID NO:5.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, the isolated alteration-specific probe or alteration-specific primer comprises at least about 15 nucleotides, wherein the alteration-specific probe or alteration-specific primer comprises a nucleotide sequence which is complementary to the nucleotide sequence of a portion of an ERAP1 nucleic acid molecule, or the complement thereof. In some embodiments, the portion comprises a position corresponding to: position 19,474 according to SEQ ID NO:2, or the complement thereof; position 1,841 according to SEQ ID NO:7, or the complement thereof; or position 1,841 according to SEQ ID NO:10, or the complement thereof. In some embodiments, the portion comprises a position corresponding to: position 21,595 according to SEQ ID NO:3, or the complement thereof; position 1,981 according to SEQ ID NO:8, or the complement thereof; or position 1,981 according to SEQ ID NO:11, or the complement thereof. In some embodiments, the portion comprises a position corresponding to: position 21,811 according to SEQ ID NO:4, or the complement thereof. In some embodiments, the portion comprises a position corresponding to: position 42,579 according to SEQ ID NO:5, or the complement thereof.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to ERAP1 variant genomic nucleic acid molecules, ERAP1 variant mRNA molecules, and/or ERAP1 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence of an ERAP1 variant nucleic acid molecule, wherein the portion comprises a position corresponding to: position 19,474 according to SEQ ID NO:2, or the complement thereof; position 1,841 according to SEQ ID NO:7, or the complement thereof; or position 1,841 according to SEQ ID NO:10, or the complement thereof. In some embodiments, the portion comprises positions corresponding to: positions 19,473-19,475 according to SEQ ID NO:2, or the complement thereof; positions 1,840-1,842 according to SEQ ID NO:7, or the complement thereof; and/or positions 1,840-1,842 according to SEQ ID NO:10, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence of an ERAP1 variant nucleic acid molecule, wherein the portion comprises a position corresponding to: position 21,595 according to SEQ ID NO:3, or the complement thereof; position 1,981 according to SEQ ID NO:8, or the complement thereof; or position 1,981 according to SEQ ID NO:11, or the complement thereof. In some embodiments, the portion comprises positions corresponding to: positions 21,595-21,597 according to SEQ ID NO:3, or the complement thereof; positions 1,981-1,983 according to SEQ ID NO:8, or the complement thereof; and/or positions 1,981-1,983 according to SEQ ID NO:11, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence of an ERAP1 variant nucleic acid molecule, wherein the portion comprises a position corresponding to: position 21,811 according to SEQ ID NO:4, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence of an ERAP1 variant nucleic acid molecule, wherein the portion comprises a position corresponding to: position 42,579 according to SEQ ID NO:5, or the complement thereof.

In some embodiments, the isolated alteration-specific probe or alteration-specific primer comprises at least about 15 nucleotides, wherein the alteration-specific probe or alteration-specific primer comprises a nucleotide sequence which is complementary to the nucleotide sequence of a portion of an ERAP1 nucleic acid molecule, or the complement thereof. In some embodiments, the portion comprises a position corresponding to: position 19,474 according to SEQ ID NO:2, or the complement thereof; position 21,595 according to SEQ ID NO:3, or the complement thereof; position 21,811 according to SEQ ID NO:4, or the complement thereof; position 42,579 according to SEQ ID NO:5, or the complement thereof.

In some embodiments, the portion comprises positions corresponding to: positions 19,473-19,475 according to SEQ ID NO:2, or the complement thereof; positions 21,595-21,597 according to SEQ ID NO:3, or the complement thereof.

In some embodiments, the portion comprises a position corresponding to: position 1,841 according to SEQ ID NO:7, or the complement thereof; or position 1,981 according to SEQ ID NO:8, or the complement thereof.

In some embodiments, the portion comprises positions corresponding to: positions 1,840-1,842 according to SEQ ID NO:7, or the complement thereof; or positions 1,981-1,983 according to SEQ ID NO:8, or the complement thereof.

In some embodiments, the portion comprises a position corresponding to: position 1,841 according to SEQ ID NO:10, or the complement thereof; or position 1,981 according to SEQ ID NO:11, or the complement thereof.

In some embodiments, the portion comprises positions corresponding to: positions 1,840-1,842 according to SEQ ID NO:10, or the complement thereof; or positions 1,981-1,983 according to SEQ ID NO:11, or the complement thereof.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the ERAP1 variant genomic nucleic acid molecules, ERAP1 variant mRNA molecules, and/or ERAP1 variant cDNA molecules disclosed herein. The primers described herein can be used to amplify the ERAP1 variant genomic nucleic acid molecules, ERAP1 variant mRNA molecules, or ERAP1 variant cDNA molecules, or a fragment thereof.

The present disclosure also provides pairs of primers comprising any of the primers described above. For example, if one of the primers' 3'-ends hybridizes to an adenine at a position corresponding to position 19,474 according to SEQ ID NO:1 (rather than a guanine) in a particular ERAP1 nucleic acid molecule, then the presence of the amplified fragment would indicate the presence of an ERAP1 reference genomic nucleic acid molecule. Conversely, if one of the primers' 3'-ends hybridizes to a guanine at a position corresponding to position 19,474 according to SEQ ID NO:2 (rather than an adenine) in a particular ERAP1 nucleic acid molecule, then the presence of the amplified fragment would indicate the presence of the ERAP1 variant genomic nucleic acid molecule. In some embodiments, the nucleotide of the primer complementary to the guanine at a position corresponding to position 19,474 according to SEQ ID NO:2 can be at the 3' end of the primer. In addition, if one of the primers' 3'-ends hybridizes to an adenine at a position corresponding to position 1,841 according to SEQ IS NO:6 (rather than a guanine) in a particular ERAP1 nucleic acid molecule, then the presence of the amplified fragment would indicate the presence of an ERAP1 reference mRNA molecule. Conversely, if one of the primers' 3'-ends hybridizes to a guanine at a position corresponding to position 1,841 according to SEQ ID NO:7 (rather than an adenine) in a particular ERAP1 mRNA molecule, then the presence of the amplified fragment would indicate the presence of the ERAP1 variant mRNA molecule. In some embodiments, the nucleotide of the primer complementary to the guanine at a position corresponding to position 1,841 according to SEQ ID NO:7 can be at the 3' end of the primer. In addition, if one of the primers' 3'-ends hybridizes to an adenine at a position corresponding to position 1,841 according to SEQ ID NO:9 (rather than a guanine) in a particular ERAP1 nucleic acid molecule, then the presence of the amplified fragment would indicate the presence of an ERAP1 reference cDNA molecule. Conversely, if one of the primers' 3'-ends hybridizes to a guanine at a position corresponding to position 1,841 according to SEQ ID NO:10 (rather than an adenine) in a particular ERAP1 cDNA molecule, then the presence of the amplified fragment would indicate the presence of the ERAP1 variant cDNA molecule. In some embodiments, the nucleotide of the primer complementary to the guanine at a position corresponding to position 1,841 according to SEQ ID NO:10 can be at the 3' end of the primer.

The present disclosure also provides pairs of primers comprising any of the primers described above. For example, if one of the primers' 3'-ends hybridizes to a guanine at a position corresponding to position 21,595 according to SEQ ID NO:1 (rather than an adenine) in a particular ERAP1 nucleic acid molecule, then the presence of the amplified fragment would indicate the presence of an ERAP1 reference genomic nucleic acid molecule. Conversely, if one of the primers' 3'-ends hybridizes to an adenine at a position corresponding to position 21,595 according to SEQ ID NO:3 (rather than a guanine) in a particular ERAP1 nucleic acid molecule, then the presence of the amplified fragment would indicate the presence of the ERAP1 variant genomic nucleic acid molecule. In some embodiments, the nucleotide of the primer complementary to the adenine at a position corresponding to position 21,595 according to SEQ ID NO:3 can be at the 3' end of the primer. In addition, if one of the primers' 3'-ends hybridizes to a guanine at a position corresponding to position 1,981 according to SEQ IS NO:6 (rather than an adenine) in a particular ERAP1 nucleic acid molecule, then the presence of the amplified fragment would indicate the presence of an ERAP1 reference mRNA molecule. Conversely, if one of the primers' 3'-ends hybridizes to an adenine at a position corresponding to position 1,981 according to SEQ ID NO:8 (rather than a guanine) in a particular ERAP1 mRNA molecule, then the presence of the amplified fragment would indicate the presence of the ERAP1 variant mRNA molecule. In some embodiments, the nucleotide of the primer complementary to the adenine at a position corresponding to position 1,981 according to SEQ ID NO:8 can be at the 3' end of the primer. In addition, if one of the primers' 3'-ends hybridizes to a guanine at a position corresponding to position 1,981 according to SEQ ID NO:9 (rather than an adenine) in a particular ERAP1 nucleic acid molecule, then the presence of the amplified fragment would indicate the presence of an ERAP1 reference cDNA molecule. Conversely, if one of the primers' 3'-ends hybridizes to an adenine at a position corresponding to position 1,981 according to SEQ ID NO:11 (rather than a guanine) in a particular ERAP1 cDNA molecule, then the presence of the amplified fragment would indicate the presence of the ERAP1 variant cDNA molecule. In some embodiments, the nucleotide of the primer complementary to the adenine at a position corresponding to position 1,981 according to SEQ ID NO:11 can be at the 3' end of the primer.

The present disclosure also provides pairs of primers comprising any of the primers described above. For example, if one of the primers' 3'-ends hybridizes to a thymine at a position corresponding to position 21,811 according to SEQ ID NO:1 (rather than a cytosine) in a particular ERAP1 nucleic acid molecule, then the presence of the amplified fragment would indicate the presence of an ERAP1 reference genomic nucleic acid molecule. Conversely, if one of the primers' 3'-ends hybridizes to a cytosine at a position corresponding to position 21,811 according to SEQ ID NO:4 (rather than a thymine) in a particular ERAP1 nucleic acid molecule, then the presence of the amplified fragment would indicate the presence of the ERAP1 variant genomic nucleic acid molecule. In some embodiments, the nucleotide of the primer complementary to the cytosine at a position corresponding to position 21,811 according to SEQ ID NO:4 can be at the 3' end of the primer.

The present disclosure also provides pairs of primers comprising any of the primers described above. For example, if one of the primers' 3'-ends hybridizes to a cytosine at a position corresponding to position 42,579 according to SEQ ID NO:1 (rather than a thymine) in a particular ERAP1 nucleic acid molecule, then the presence of the amplified fragment would indicate the presence of an ERAP1 reference genomic nucleic acid molecule. Conversely, if one of the primers' 3'-ends hybridizes to a thymine at a position corresponding to position 42,579 according to SEQ ID NO:5 (rather than a cytosine) in a particular ERAP1 nucleic acid molecule, then the presence of the amplified fragment would indicate the presence of the ERAP1 variant genomic nucleic acid molecule. In some embodiments, the nucleotide of the primer complementary to the thymine at a position corresponding to position 42,579 according to SEQ ID NO:5 can be at the 3' end of the primer.

In the context of the present disclosure "specifically hybridizes" means that the probe or primer (such as, for example, the alteration-specific probe or alteration-specific primer) does not hybridize to a nucleotide sequence encoding an ERAP1 reference genomic nucleic acid molecule, an ERAP1 reference mRNA molecule, and/or an ERAP1 reference cDNA molecule.

In any of the embodiments described throughout the present disclosure, the probes (such as, for example, an alteration-specific probe) can comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well. In some embodiments, the support is a microarray.

The present disclosure also provides molecular complexes comprising or consisting of any of the ERAP1 nucleic acid molecules (genomic nucleic acid molecules, mRNA molecules, or cDNA molecules), or complement thereof, described herein and any of the alteration-specific primers or alteration-specific probes described herein. In some embodiments, the ERAP1 nucleic acid molecules (genomic nucleic acid molecules, mRNA molecules, or cDNA molecules), or complement thereof, in the molecular complexes are single-stranded. In some embodiments, the ERAP1 nucleic acid molecule is any of the genomic nucleic acid molecules described herein. In some embodiments, the ERAP1 nucleic acid molecule is any of the mRNA molecules described herein. In some embodiments, the ERAP1 nucleic acid molecule is any of the cDNA molecules described herein. In some embodiments, the molecular complex comprises or consists of any of the ERAP1 nucleic acid molecules (genomic nucleic acid molecules, mRNA molecules, or cDNA molecules), or complement thereof, described herein and any of the alteration-specific primers described herein. In some embodiments, the molecular complex comprises or consists of any of the ERAP1 nucleic acid molecules (genomic nucleic acid molecules, mRNA molecules, or cDNA molecules), or complement thereof, described herein and any of the alteration-specific probes described herein.

In some embodiments, the molecular complex comprises an alteration-specific primer or an alteration-specific probe hybridized to an ERAP1 genomic nucleic acid molecule, wherein the alteration-specific primer or the alteration-specific probe is hybridized to the ERAP1 genomic nucleic acid molecule at a position corresponding to: position 19,474 according to SEQ ID NO:2, or the complement thereof; position 21,595 according to SEQ ID NO:3, or the complement thereof; position 21,811 according to SEQ ID NO:4, or the complement thereof; or position 42,579 according to SEQ ID NO:5, or the complement thereof.

In some embodiments, the alteration-specific primer or the alteration-specific probe in the molecular complex is hybridized to: an AGG codon at positions corresponding to positions 19,473-19,475 according to SEQ ID NO:2 or an AAC codon at positions corresponding to positions 21,595-21,597 according to SEQ ID NO:3.

In some embodiments, the genomic nucleic acid molecule in the molecular complex comprises SEQ ID NO:2, SEQ ID NO:3, SEQ ID NO:4, or SEQ ID NO:5.

In some embodiments, the molecular complex comprises an alteration-specific primer or an alteration-specific probe hybridized to an ERAP1 mRNA molecule, wherein the alteration-specific primer or the alteration-specific probe is hybridized to the ERAP1 mRNA molecule at a position corresponding to: position 1,841 according to SEQ ID NO:7, or the complement thereof; or position 1,981 according to SEQ ID NO:8, or the complement thereof.

In some embodiments, the alteration-specific primer or the alteration-specific probe in the molecular complex is hybridized to: an AGG codon at positions corresponding to positions 1,840-1,842 according to SEQ ID NO:7 or an AAC codon at positions corresponding to positions 1,981-1,983 according to SEQ ID NO:8.

In some embodiments, the mRNA molecule in the molecular complex comprises SEQ ID NO:7 or SEQ ID NO:8.

In some embodiments, the molecular complex comprises an alteration-specific primer or an alteration-specific probe hybridized to an ERAP1 cDNA molecule, wherein the alteration-specific primer or the alteration-specific probe is hybridized to the ERAP1 cDNA molecule at a position corresponding to: position 1,841 according to SEQ ID NO:10, or the complement thereof; or position 1,981 according to SEQ ID NO:11, or the complement thereof.

In some embodiments, the alteration-specific primer or the alteration-specific probe in the molecular complex is hybridized to: an AGG codon at positions corresponding to positions 1,840-1,842 according to SEQ ID NO:10 or an AAC codon at positions corresponding to positions 1,981-1,983 according to SEQ ID NO:1.

In some embodiments, the cDNA molecule in the molecular complex comprises SEQ ID NO:10, SEQ ID NO:11.

In some embodiments, the molecular complex comprises an alteration-specific probe or an alteration-specific primer comprising a label. In some embodiments, the label is a fluorescent label, a radiolabel, or biotin. In some embodiments, the molecular complex further comprises a non-human polymerase.

The nucleotide sequence of an ERAP1 reference genomic nucleic acid molecule is set forth in SEQ ID NO:1. Referring to SEQ ID NO:1, position 19,474 is an adenine. Referring to SEQ ID NO:1, position 21,595 is a guanine. Referring to SEQ ID NO:1, position 21,811 is a thymine. Referring to SEQ ID NO:1, position 42,579 is a cytosine.

An ERAP1 variant genomic nucleic acid molecule exists, wherein the adenine at position 19,474 is replaced with a guanine. The nucleotide sequence of this ERAP1 variant genomic nucleic acid molecule is set forth in SEQ ID NO:2.

Another ERAP1 variant genomic nucleic acid molecule exists, wherein the guanine at position 21,595 is replaced with an adenine. The nucleotide sequence of this ERAP1 variant genomic nucleic acid molecule is set forth in SEQ ID NO:3.

Another ERAP1 variant genomic nucleic acid molecule exists, wherein the thymine at position 21,811 is replaced with a cytosine. The nucleotide sequence of this ERAP1 variant genomic nucleic acid molecule is set forth in SEQ ID NO:4.

Another ERAP1 variant genomic nucleic acid molecule exists, wherein the cytosine at position 42,579 is replaced with a thymine. The nucleotide sequence of this ERAP1 variant genomic nucleic acid molecule is set forth in SEQ ID NO:5.

The nucleotide sequence of an ERAP1 reference mRNA molecule is set forth in SEQ ID NO:6. Referring to SEQ IS NO:6, position 1,841 is an adenine. Referring to SEQ ID NO:6, position 1,981 is a guanine.

An ERAP1 variant mRNA molecule exists, wherein the adenine at position 1,841 is replaced with a guanine. The nucleotide sequence of this ERAP1 variant mRNA molecule is set forth in SEQ ID NO:7.

Another ERAP1 variant mRNA molecule exists, wherein the guanine at position 1,981 is replaced with an adenine. The nucleotide sequence of this ERAP1 variant mRNA molecule is set forth in SEQ ID NO:8.

The nucleotide sequence of an ERAP1 reference cDNA molecule is set forth in SEQ ID NO:9. Referring to SEQ ID NO:9, position 1,841 is an adenine. Referring to SEQ ID NO:9, position 1,981 is a guanine.

An ERAP1 variant cDNA molecule exists, wherein the adenine at position 1,841 is replaced with a guanine. The nucleotide sequence of this ERAP1 variant cDNA molecule is set forth in SEQ ID NO:10.

Another ERAP1 variant cDNA molecule exists, wherein the guanine at position 1,981 is replaced with an adenine. The nucleotide sequence of this ERAP1 variant cDNA molecule is set forth in SEQ ID NO:11.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ IS NO:6, or SEQ ID NO:9). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, an ERAP1 nucleic acid molecule comprising a nucleotide sequence that comprises a guanine at a position corresponding to position 19,474 according to SEQ ID NO:2 means that if the nucleotide sequence of the ERAP1 genomic nucleic acid molecule is aligned to the sequence of SEQ ID NO:2, the ERAP1 sequence has a guanine residue at the position that corresponds to position 19,474 of SEQ ID NO:2. The same applies for ERAP1 mRNA molecules comprising a nucleotide sequence that comprises a guanine at a position corresponding to position 1,841 according to SEQ ID NO:7, and ERAP1 cDNA molecules comprising a nucleotide sequence that comprises a guanine at a position corresponding to position 1,841 according to SEQ ID NO:10). These phrases refer to an ERAP1 nucleic acid molecule, wherein the genomic nucleic acid molecule has a nucleotide sequence that comprises a guanine residue that is homologous to the guanine residue at position 19,474 of SEQ ID NO:2 (or wherein the mRNA molecule has a nucleotide sequence that comprises a guanine residue that is homologous to the guanine residue at position 1,841 of SEQ ID NO:7, or wherein the cDNA molecule has a nucleotide sequence that comprises a guanine residue that is homologous to the guanine residue at position 1,841 of SEQ ID NO:10).

As described herein, a position within an ERAP1 genomic nucleic acid molecule that corresponds to position 19,474 according to SEQ ID NO:2, for example, can be identified by performing a sequence alignment between the nucleotide sequence of a particular ERAP1 nucleic acid molecule and the nucleotide sequence of SEQ ID NO:2. A variety of computational algorithms exist that can be used for performing a sequence alignment to identify a nucleotide position that corresponds to, for example, position 19,474 in SEQ ID NO:2. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequence of an ERAP1 reference polypeptide is set forth in SEQ ID NO:12. Referring to SEQ ID NO:12, the ERAP1 reference polypeptide is 948 amino acids in length. Referring to SEQ ID NO:12, position 528 is a lysine. Referring to SEQ ID NO:12, position 575 is an aspartic acid.

An ERAP1 predicted loss-of-function polypeptide exists (Lys528Arg), the amino acid sequence of which is set forth in SEQ ID NO:13. Referring to SEQ ID NO:13, the ERAP1 predicted loss-of-function polypeptide is 948 amino acids in length. Referring to SEQ ID NO:13, position 528 is an arginine.

Another ERAP1 predicted loss-of-function polypeptide exists (Asp575Asn), the amino acid sequence of which is set forth in SEQ ID NO:14. Referring to SEQ ID NO:14, the ERAP1 predicted loss-of-function polypeptide is 948 amino acids in length. Referring to SEQ ID NO:14, position 575 is an asparagine.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit uveitis, such as anterior uveitis, for use in the treatment of uveitis (or for use in the preparation of a medicament for treating uveitis) in a subject, wherein the subject has any of the ERAP1 variant genomic nucleic acid molecules, variant mRNA molecules, and/or variant cDNA molecules described herein. The therapeutic agents that treat or inhibit uveitis can be any of the therapeutic agents that treat or inhibit uveitis described herein.

In some embodiments, the subject is identified as having an ERAP1 variant genomic nucleic acid molecule, or the complement thereof, wherein the genomic nucleic acid molecule has a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof.

In some embodiments, the subject is identified as having an ERAP1 variant mRNA molecule, or the complement thereof, wherein the mRNA molecule has a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof.

In some embodiments, the subject is identified as having an ERAP1 variant cDNA molecule, or the complement thereof, wherein the cDNA molecule has a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

In some embodiments, the subject is identified as having: a genomic nucleic acid molecule having a nucleotide sequence that comprises a guanine at a position corresponding to position 19,474 according to SEQ ID NO:2, or the complement thereof; an mRNA molecule having a nucleotide sequence that comprises a guanine at a position corresponding to position 1,841 according to SEQ ID NO:7, or the complement thereof; a cDNA molecule having a nucleotide sequence that comprises a guanine at a position corresponding to position 1,841 according to SEQ ID NO:10, or the complement thereof; or an ERAP1 predicted loss-of-function polypeptide that comprises an arginine at a position corresponding to position 528 according to SEQ ID NO:13.

In some embodiments, the subject is identified as having: a genomic nucleic acid molecule having a nucleotide sequence that comprises an adenine at a position corresponding to position 21,595 according to SEQ ID NO:3, or the complement thereof; an mRNA molecule having a nucleotide sequence that comprises an adenine at a position corresponding to position 1,981 according to SEQ ID NO:8, or the complement thereof; a cDNA molecule having a nucleotide sequence that comprises an adenine at a position corresponding to position 1,981 according to SEQ ID NO:11, or the complement thereof; or an ERAP1 predicted loss-of-function polypeptide that comprises an asparagine at a position corresponding to position 575 according to SEQ ID NO:14.

In some embodiments, the subject is identified as having: a genomic nucleic acid molecule having a nucleotide sequence that comprises a cytosine at a position corresponding to position 21,811 according to SEQ ID NO:4, or the complement thereof.

In some embodiments, the subject is identified as having: a genomic nucleic acid molecule having a nucleotide sequence that comprises a thymine at a position corresponding to position 42,579 according to SEQ ID NO:5, or the complement thereof.

The present disclosure also provides ERAP1 inhibitors for use in the treatment of uveitis, such as anterior uveitis (or for use in the preparation of a medicament for treating uveitis) in a subject, wherein the subject is heterozygous for any of the ERAP1 variant genomic nucleic acid molecules, variant mRNA molecules, and/or variant cDNA molecules described herein, or wherein the subject is reference for an ERAP1 genomic nucleic acid molecule, mRNA molecule, or cDNA molecule.

In some embodiments, the subject is reference for an ERAP1 genomic nucleic acid molecule, an ERAP1 mRNA molecule, or an ERAP1 cDNA molecule.

In some embodiments, the subject is heterozygous for a genomic nucleic acid molecule, or the complement thereof, wherein the genomic nucleic acid molecule has a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof.

In some embodiments, the subject is heterozygous for an mRNA molecule, or the complement thereof, wherein the mRNA molecule has a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof.

In some embodiments, the subject is heterozygous for a cDNA molecule, or the complement thereof, wherein the cDNA molecule has a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

In some embodiments, the subject is identified as being heterozygous for: a genomic nucleic acid molecule having a nucleotide sequence that comprises a guanine at a position corresponding to position 19,474 according to SEQ ID NO:2, or the complement thereof; an mRNA molecule having a nucleotide sequence that comprises a guanine at a position corresponding to position 1,841 according to SEQ ID NO:7, or the complement thereof; a cDNA molecule having a nucleotide sequence that comprises a guanine at a position corresponding to position 1,841 according to SEQ ID NO:10, or the complement thereof; or an ERAP1 predicted loss-of-function polypeptide that comprises an arginine at a position corresponding to position 528 according to SEQ ID NO:13. The ERAP1 inhibitors can be any of the ERAP1 inhibitors described herein.

In some embodiments, the subject is identified as being heterozygous for: a genomic nucleic acid molecule having a nucleotide sequence that comprises an adenine at a position corresponding to position 21,595 according to SEQ ID NO:3, or the complement thereof; an mRNA molecule having a nucleotide sequence that comprises an adenine at a position corresponding to position 1,981 according to SEQ ID NO:8, or the complement thereof; a cDNA molecule having a nucleotide sequence that comprises an adenine at a position corresponding to position 1,981 according to SEQ ID NO:11, or the complement thereof; or an ERAP1 predicted loss-of-function polypeptide that comprises an asparagine at a position corresponding to position 575 according to SEQ ID NO:14. The ERAP1 inhibitors can be any of the ERAP1 inhibitors described herein.

In some embodiments, the subject is identified as being heterozygous for: a genomic nucleic acid molecule having a nucleotide sequence that comprises a cytosine at a position corresponding to position 21,811 according to SEQ ID NO:4, or the complement thereof. The ERAP1 inhibitors can be any of the ERAP1 inhibitors described herein.

In some embodiments, the subject is identified as being heterozygous for: a genomic nucleic acid molecule having a nucleotide sequence that comprises a thymine at a position corresponding to position 42,579 according to SEQ ID NO:5, or the complement thereof. The ERAP1 inhibitors can be any of the ERAP1 inhibitors described herein.

In some embodiments, the subject is identified as having: an ERAP1 reference genomic nucleic acid molecule comprising SEQ ID NO:1, an ERAP1 reference mRNA molecule comprising SEQ IS NO:6, an ERAP1 reference cDNA molecule comprising SEQ ID NO:9, or an ERAP1 reference polypeptide comprising SEQ ID NO:12. The ERAP1 inhibitors can be any of the ERAP1 inhibitors described herein.

The present disclosure also provides a combination of one or more ERAP1 inhibitors and one or more HLA-B27 inhibitors for use in the treatment of uveitis, such as anterior uveitis (or for use in the preparation of a medicament for treating uveitis) in a subject, wherein the subject is heterozygous for any of the ERAP1 variant genomic nucleic acid molecules, variant mRNA molecules, and/or variant cDNA molecules described herein, or wherein the subject is reference for an ERAP1 genomic nucleic acid molecule, mRNA molecule, or cDNA molecule.

In some embodiments, the subject is reference for an ERAP1 genomic nucleic acid molecule, an ERAP1 mRNA molecule, or an ERAP1 cDNA molecule.

In some embodiments, the subject is heterozygous for a genomic nucleic acid molecule, or the complement thereof, wherein the genomic nucleic acid molecule has a nucleotide sequence comprising: a guanine at a position corresponding to position 19,474 according to SEQ ID NO:2, or the complement thereof; an adenine at a position corresponding to position 21,595 according to SEQ ID NO:3, or the complement thereof; a cytosine at a position corresponding to position 21,811 according to SEQ ID NO:4, or the complement thereof; or a thymine at a position corresponding to position 42,579 according to SEQ ID NO:5, or the complement thereof.

In some embodiments, the subject is heterozygous for an mRNA molecule, or the complement thereof, wherein the mRNA molecule has a nucleotide sequence comprising: a guanine at a position corresponding to position 1,841 according to SEQ ID NO:7, or the complement thereof; or an adenine at a position corresponding to position 1,981 according to SEQ ID NO:8, or the complement thereof.

In some embodiments, the subject is heterozygous for a cDNA molecule, or the complement thereof, wherein the cDNA molecule has a nucleotide sequence comprising: a guanine at a position corresponding to position 1,841 according to SEQ ID NO:10, or the complement thereof; or an adenine at a position corresponding to position 1,981 according to SEQ ID NO:11, or the complement thereof.

In some embodiments, the subject is identified as being heterozygous for: a genomic nucleic acid molecule having a nucleotide sequence that comprises a guanine at a position corresponding to position 19,474 according to SEQ ID NO:2, or the complement thereof; an mRNA molecule having a nucleotide sequence that comprises a guanine at a position corresponding to position 1,841 according to SEQ ID NO:7, or the complement thereof; a cDNA molecule having a nucleotide sequence that comprises a guanine at a position corresponding to position 1,841 according to SEQ ID NO:10, or the complement thereof; or an ERAP1 predicted loss-of-function polypeptide that comprises an arginine at a position corresponding to position 528 according to SEQ ID NO:13. The ERAP1 inhibitors can be any of the ERAP1 inhibitors described herein.

In some embodiments, the subject is identified as being heterozygous for: a genomic nucleic acid molecule having a nucleotide sequence that comprises an adenine at a position corresponding to position 21,595 according to SEQ ID NO:3, or the complement thereof; an mRNA molecule having a nucleotide sequence that comprises an adenine at a position corresponding to position 1,981 according to SEQ ID NO:8, or the complement thereof; a cDNA molecule having a nucleotide sequence that comprises an adenine at a position corresponding to position 1,981 according to SEQ ID NO:11, or the complement thereof; or an ERAP1 predicted loss-of-function polypeptide that comprises an asparagine at a position corresponding to position 575 according to SEQ ID NO:14. The ERAP1 inhibitors can be any of the ERAP1 inhibitors described herein.

In some embodiments, the subject is identified as being heterozygous for: a genomic nucleic acid molecule having a nucleotide sequence that comprises a cytosine at a position corresponding to position 21,811 according to SEQ ID NO:4, or the complement thereof. The ERAP1 inhibitors can be any of the ERAP1 inhibitors described herein.

In some embodiments, the subject is identified as being heterozygous for: a genomic nucleic acid molecule having a nucleotide sequence that comprises a thymine at a position corresponding to position 42,579 according to SEQ ID NO:5, or the complement thereof. The ERAP1 inhibitors can be any of the ERAP1 inhibitors described herein.

In some embodiments, the subject is identified as having: an ERAP1 reference genomic nucleic acid molecule comprising SEQ ID NO:1, an ERAP1 reference mRNA molecule comprising SEQ IS NO:6, an ERAP1 reference cDNA molecule comprising SEQ ID NO:9, or an ERAP1 reference polypeptide comprising SEQ ID NO:12. The ERAP1 inhibitors can be any of the ERAP1 inhibitors described herein.

The present disclosure also provides pharmaceutical compositions comprising one or more ERAP1 inhibitors in combination with one or more HLA-B27 inhibitors.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: General Methodology

Sequencing and Genotyping

Genotyping and exome sequencing were performed as previously described (Verweij et al., N. Engl. J. Med., 2022, 387, 332-344). In short, for analyses of common variants, array genotyping data was used and imputation was performed with the use of the TOPMed panel (Taliun et al., Nature, 2021, 590, 290-299) in all cohorts analyzed. Exome sequencing for rare variant analysis was performed with the use of Illumina HiSeq 2500-v4 or Illumina NovaSeq instruments, with 75-bp paired-end reads (Taliun et al., Nature, 2021, 590, 290-299). Deleterious variants were considered if annotated as: frameshift, stop-gain, stop-loss, splice acceptor, splice donor, in-frame insertion or deletion (indel), missense, and other annotations. Frameshift, stop-gain, stop-loss, splice-acceptor, and splice-donor alleles were categorized as predicted loss-of-function variants. The alternative-allele frequency and functional annotation of each variant were used to generate seven genotypes based on the combined variant burden: predicted loss-of-function variants with an alternative-allele frequency thresholds of 1% and 0.1%, predicted loss-of-function variants plus missense variants that were predicted to be deleterious and had an alternative-allele frequency thresholds of 1% and 0.1%.

Samples

Genome-wide association analyses were performed in the U. K. Biobank population-based cohort, and in the Geisinger Health System MyCode cohort. Others datasets: 29,237 from the Malmo Diet and Cancer Study, 41,400 participants from the University of Pennsylvania Penn Medicine BioBank, 29,845 participants from the Mount Sinai BioMe BioBank, 49,004 from the Colorado cohort, 40,197 from the UCLA cohort, and 115,418 participants MAYO-clinic cohort.

Exome Sequencing and Whole-Genome Genotyping

For analyses of common variants, array genotyping data was used and imputation was performed with the use of the TOPMed reference panel (Taliun et al., bioRxiv, 563866, doi:10.1101/563866, 2019; and Das et al., Nat. Genet., 2016, 48, 1284-1287). High-coverage exome sequencing was performed with the use of Illumina HiSeq 2500-v4 or Illumina NovaSeq instruments, with 75-bp paired-end reads. The GRCh38 human genome reference sequence and Ensembl, version 85, gene definitions were used for variant identification and annotation. Variants were classified from most to least deleterious in the following order: frameshift, stop-gain, stop-loss, splice acceptor, splice donor, in-frame insertion or deletion (indel), missense, and other annotations. Frameshift, stop-gain, stop-loss, splice-acceptor, and splice-donor alleles were categorized as predicted loss-of-function variants. Missense variants were classified using computer modeling to predict functional effects with five algorithms: SIFT, Polyphen-2 HDIV, Polyphen-2 HVAR, LRT, and MutationTaster. To account for the fact that different genes have different types and frequencies of potentially causative variants, the alternative-allele frequency and functional annotation of each variant was used to generate seven genotypes based on the combined variant burden: predicted loss-of-function variants with an alternative-allele frequency of less than 1%, predicted loss-of-function variants plus missense variants that were predicted to be deleterious by five of five algorithms and had an alternative-allele frequency of less than 1% or less than 0.1%, predicted loss-of-function variants plus missense variants that were predicted to be deleterious by at least one of five algorithms and had an alternative-allele frequency of less than 1% or less than 0.1%, and predicted loss-of-function variants plus any missense variants with an alternative-allele frequency of less than 1% or less than 0.1%.

Statistical Analysis

Associations between genotypes and phenotypes was estimated by fitting linear regression models (for quantitative traits) or Firth bias-corrected logistic regression models (for binary traits) using REGENIE software, version 2+. Analyses were stratified according to cohort and ancestry and were adjusted for age, age squared, sex, age-by-sex, and age squared-by-sex interaction terms; experimental batch-related covariates; the first 10 common variant-derived genetic principal components; the first 20 rare variant-derived principal components; and a polygenic score generated by REGENIE, which robustly adjusts for relatedness and population structure. A meta-analysis of association results across cohorts and ancestries was performed with a fixed-effect inverse-variance-weighted approach. For other analyses, a two-tailed P value of 0.05 was used.

Example 2: Decreased Expression of ERAP1 is Protective for B27-Anterior Uveitis

For the largest AU case cohort to date, eight large EHR based populations, reaching 3,850 AU cases and 916,325 controls (Table 2) were sequenced.

TABLE 2

Overview of studies included in the meta-analysis

| Cohort | EUR | | ALL | |
| --- | --- | --- | --- | --- |
| | Cases (% B27) | Ctrls (% B27) | Cases (% B27) | Ctrls (% B27) |
| UKB450k | 1,260 ( ) | 429,728 ( ) | 1,388 ( ) | 452,976 ( ) |
| GHS175K | 1,007 | 150,547 | 1,066 | 159,644 |
| UPenn-PMBB | 75 | 28,426 | 233 | 41,167 |
| Sinai | 51 | 10,681 | 169 | 29,676 |
| MALMO | 114 | 28,834 | 116 | 29,121 |
| MAYO-Clinic | 331 | 110,930 | 355 | 115,063 |
| UCLA | 161 | 26,276 | 305 | 39,892 |
| Colorado | 181 | 40,980 | 218 | 48,786 |
| Total | 3,180 | 826,402 | 3,850 | 916,325 |

Examining the association of common variants, two genome wide significant signals were discovered: a risk signal for rs543685299 at the HLA-B locus (OR(95% CI)=3.37 (3.12-3.65), p=7.82E-197) and a signal for rs3198304 at the ERAP1 locus (OR(95% CI)=0.84 (0.79-0.89), p=5.02e-9) that presents protection from AU (data not shown). The top ERAP1 SNP shows a replicated direction of protection in 6/8 cohorts (FIG. 1) and is found significantly protective in the two larger cohorts of UKB and GHS.

The analysis was repeated using an EUR-only cohort of 3,180 EUR cases and 826,348 controls. In this less powered analysis, 17% of total cases and 10% of controls were removed, yet similar signals were found for both HLA-B (OR=3.4, p=9.7e-186) and ERAP1 (OR=0.83, p=3.2e-09).

ERAP1 is an ER-Aminopeptidase that trims peptides to be loaded and presented by MHC class-I proteins. Therefore, regulating the expression of ERAP1 will change the peptidome that is available for presentation by HLA Class-I alleles; in this case, by HLA-B27. This will have a direct effect on what antigens are presented by HLA-B27, and the subsequent activation of the immune response in AU.

Aside from the two significant common loci, no rare variants with allele frequency (AF) less than 0.5% showed genome wide significance. Similarly, several gene-burden analyses with various AF thresholds were examined and discovered no significant gene-burden results.

Example 3: ERAP1 Signal is Strengthened and is the Only Genome Wide Significant Signal in the Analysis of B27 Carriers The above results show that the strongest genetic risk for AU is attributed to HLA-B, a known signal attributable to the HLA-B27 allele (Linssen et al., Invest. Ophthalmol. Vis. Sci., 1991, 32, 2568-2578; and Sheehan, J. R. Soc. Med., 2004, 97, 10-14). This risk was observed to be different within each cohort, that ranges between OR=2.4 in the GHS cohort to OR=4.3 in the UKB cohort. To correct for this difference between the cohort, and to examine the genetic signals that underly the HLA-B27 association, the cohorts were stratified by the carrier status of HLA-B27 using the HLA-B27 tag SNP rs4349859. The HLA-B27 stratification resulted in two cohorts: 1) a B27-positive cohort with samples carrying either one or two copies of the tag SNP, and 2) a B27-negative cohort with samples carrying zero copies of the tag SNP. The B27-positive cohort consisted of 856 AU cases and 70,198 controls, suggesting that 22.23% of the AU cases carry the B27 allele, a significant enrichment than the controls, where 7.7% are B27 carriers, as expected from general population B27 frequency. The final analysis of all ancestries included 837 B27-positive AU cases and 67,755 B27-positive controls, a meta-analysis including seven main cohorts, and excluding the UPENN cohort that was underpowered for a valid analysis with 19 cases and 2,434 controls.

The HLA-B signal was completely diminished in a B27-stratified analysis, while the ERAP1 signal remained the only genome wide significant locus. Moreover, the protective effect observed was stronger when examining the small B27-stratified cohort (rs27529, OR=0.74, p=1.3e-9), even though this cohort is much less powered with only 22% of cases and 7.7% of the controls (data not shown). Furthermore, the top ERAP1 variant was part of a significant haplotype that included ERAP1 missense variant K528R-rs30187 (R2=1, D'=1). This haplotype has been shown to be an eQTL that significantly decreases ERAP1 expression and is associated with other HLA class-I related disorders such as Ankylosing Spondylitis and Psoriatic Arthritis (data not shown).

The above analysis was repeated with a EUR-only cohort, consisting of 795 AU cases and 65,628 controls. Of note, the proportion of B27-positive AU cases was higher in EUR than in the full all-ancestries analysis, reaching 25% of cases, which is still much lower than the ~50% B27-AU carriers previously reported. The proportion of B27 carriers in controls remained 8% as expected for EUR population.

Figure 2:
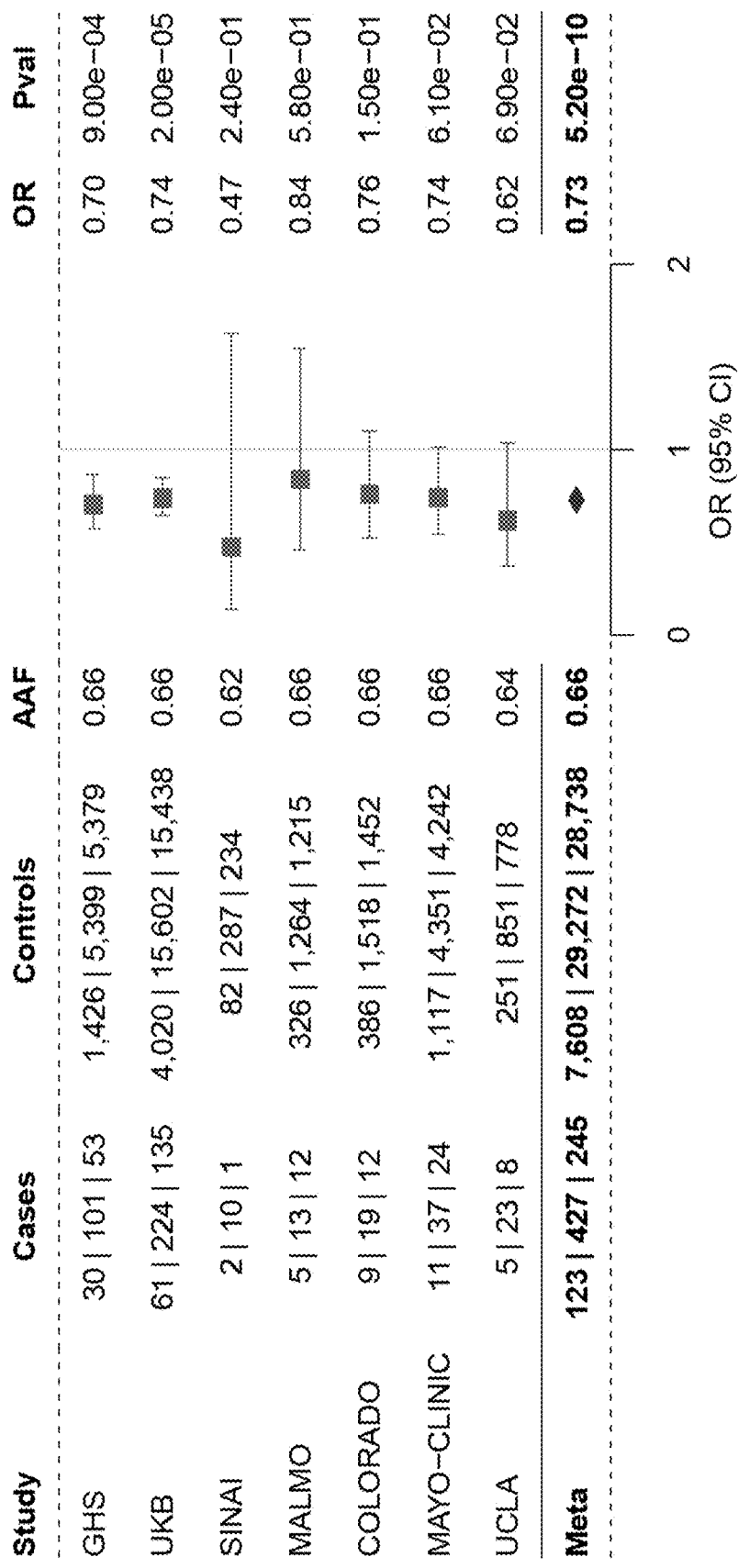
FIG. 2 shows ERAP1 protection across seven B27-positive cohorts.

The EUR-only, B27-positive analysis did also present with more significant results for the protective ERAP1 locus, exhibiting a slightly better OR (95% CI)=0.73 (1.78-3.76), and a stronger p=5.2e-10 (FIG. 2). When examining the effect of the ERAP1 haplotype across the seven remaining B27-positive cohorts, the protective effect of the common ERAP1 haplotype was evident in all cohorts, ranging from OR=0.47 in the small Sinai cohort, to OR=0.84 in the MALMO cohort. This analysis was very much underpowered considering the exclusion of most cases and controls, resulting in a nominal p-value in the two larger cohorts of GHS (184 cases) and UKB (420 cases).

AU is a symptom commonly observed in other class-I-opathies such as AS (~50%). Furthermore, a significant ERAP1 signal was observed previously for AS, which is also a B27-associated disease. Psoriatic Arthritis is another MHC-class-I disease that has similar associations with ERAP1 and AU. A strict analysis was therefore designed, removing all samples diagnosed with either AS (ICD10-M45) or Ps (ICD10-L40) from an already underpowered B27-positive cohort. When considering only B27 carriers that were not diagnosed with either AS or Ps, 618 AU cases and 67,343 controls in all eight cohorts including all ancestries were identified. This sets the proportion of AU cases that are diagnosed also with AS or Ps at 28%. Within the general B27 controls, 4% were found to have AS or Ps diagnosis.

In the final analysis of AU without AS or Ps, six cohorts that were sufficiently powered were combined and considered 605 AU cases and 64,991 controls of all ancestries. In this analysis, ERAP1 locus presented a similar protection of OR=0.75, with slightly lower p=8.2e-6. In a EUR-only analysis consisting of 569 EUR AU cases and 62,360 controls, a similar signal (OR=0.74 and p=9.6e-6) was observed.

Figure 3:
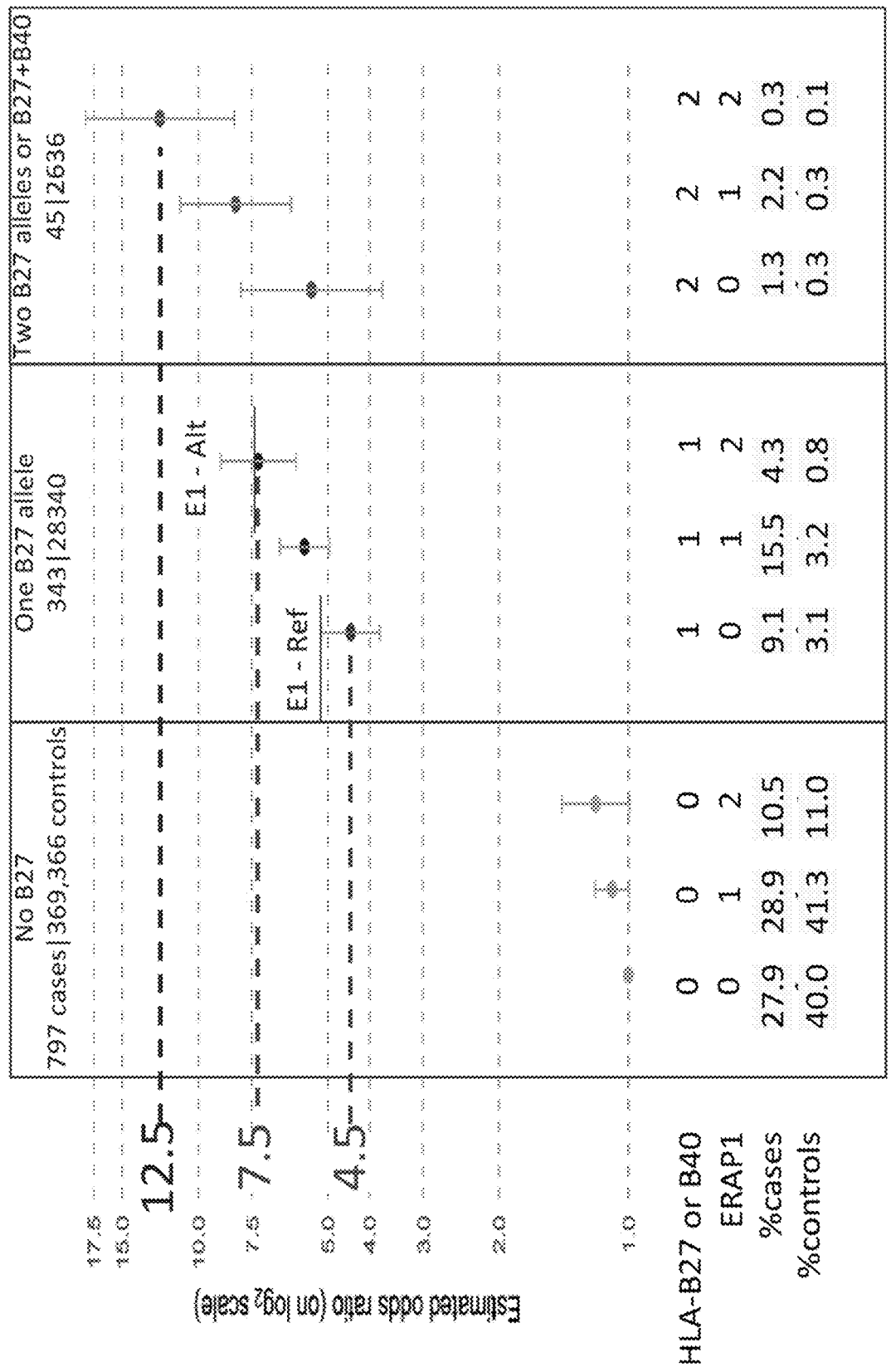
FIG. 3 shows the combined risk for anterior uveitis with ERAP1 and HLA-B27/HLA-B40.

An Additive Effect for 827-AU Risk with the Combined Effect of Having Two Copies of HLA Risk Alleles and the ERAP1 Risk Haplotypes The effect of the ERAP1 risk haplotype (tagged by r530187) was protective in subjects carrying at least one copy of the HLA-B27 allele, with a further increase in subjects carrying a second HLA-B27 allele or the HLA-B40 risk allele (FIG. 3). The risk was assessed in AU samples from the GHS+UKB cohorts combined, where HLA typing was done by imputation for increased accuracy (vs. tag SNPs). Zero HLA-B and ERAP1 risk alleles were defined as the reference risk genotype (i.e., OR=1), and assessed the risk of the ERAP1 risk allele on a B27 negative background (left panel, FIG. 3), compared to having one HLA-B27 allele (middle panel) and two copies of HLA-B27 or subjects carrying the HLA-B27 and HLA-B40 risk alleles (right panel). A moderate risk increase of OR=4.5 when carrying one HLA-B27 allele, which almost doubled with ERAP1 risk genotypes to OR=7.5, was observed. The maximum risk was with two HLA risk alleles and the full ERAP1 risk genotype, which nearly tripled the risk to OR=12.5. Taken together, these results suggest that a decreased expression of ERAP1 will decrease the risk for AU, and this effect is strongest in a HLA-B risk background.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (3661 sequences)

SEQ ID NO: 1 - DNA, 47291 bp, Homo sapiens
  source 1..47291: mol_type = genomic DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctggtggggtgggatgcgcgggccgtgtgtgttcttaaggtcacttccctccctgcttctcctgttcttctggtcagcaattctctctctccccttcgctctggctctggctgggttttattcagataaagcacctctgttgacgcaaattaaaagtttcctatctgggtgcctcactggccaggtggtcctacaaagttaattccatgaggggaagggggagagcacacacttcctcacgcttttggatttctttgtgtaggctaggttcagaaagaaattatctgtttcctattaaacacccagaggattcgctctgaactcaggacgtggtcaacaattaacaaaacaacaaaacaaaacaaaacaaaacaaaaaacttgaaaattgggcacagttgtctcttgcctgaggatttttaattagtataagtagcacattttcaggtgcggcctgaatagaaacattctagtacttttttttttttcaaattaatccagcatttttattatttaccaacagtgcttgttaatttcattgttcaggaaattctggaagaacctcaattacttcttgatgatctatttcatatactatagtgccccaataaaaggaagggaggcagaggttgcagtgagccaagatcgcaccactgcactccagcctgggagacagagcgagactccgtctcaaaaaaaaaaaaaaaaaaaaaaaagagggatcttggtgaagctgaaaaagcagggagtttatactcacacagatgtggattgcattccaacaagttgtgtgaacttagcaaagttacatgaatggttctttgcttcagttaccccaccttgaatgagaataataggctattagagagagtgagcatgtgtaaagtgcctggcactttggaggagcttagtaaatattagttctttttcctccttggcttctattcctttaagtgttagtggagtgtaacttcaaagagaattgtacttctcttgggaagagctgcttatattgagtagactactgtttttgagagctttctttttttttaactgcctccctttcagaaaattgttagtaaaaccagaccctaggagaccagccagaaccatgaaatgccatgtttcaaactggaacacttactattggaagcaaagccaaacaagagctaatttttcaggggaagagccaaacacacgaacatgatcacagaatcttggatgtagcctacagtttgggattaataagagaatttattagtgaagccctttattcactacatggagtttttaccaagccccactcatgcactgcatcctcgttgagacataactgtttctctttggacccctcatggacccaaccctgcaaagcctctgatccaaggtcccggtaccaaccccttccgcagcacatcagcctttctgtcagctcataacgagttggaatttctagatcttctctggggctgttggagaggtctcggggactttcagagtccttacatgcttgaacctgccaccttcacagagtcctctggatcccgtcttggggcaggggcgatgctcattaagctgttgctgccagtaattccatatggaaagcaaaacacaagttccatttactctctagttccccaacttcaagggcaaaaaaatgttctccctgttcacacttcctgtctcacctgggtggtgccttttgaactgggattatgagatttccaagactctctctaatgtgtaggtatcctttctgtttagcctccagattgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagttttttttttttttaaaaaaaaaaaccaaaaaccagaaattaaacaatccgtaaaaccataccccgatcttatcaccataggttccagtttaattgttgtcaataaggacccaggcatcgaaaattttaaaagcttcccaggttacattaatatgcagccagagttaggaaacttgacatctcagagagggagaattccatgtactgtgaacactttgagggatccacattgtaagcttgctacttttcccaactggaacacgaggagtttgggccaatcacttgcattcacctggtatgggcccctcttggcaaacacccattagaaaggtgcgtttgtataaaagaaataaaaacttatgtttgatgcttggggcatggtttgccaacttccttaaaattcacattgccttttttttttttttttaaagacagagtcttgctctgttgccaggctggagtgcagtggtgcaatctcagctcactgcaactctgcctcccaggttcaagcgattctcctgcctcagcctcccaagtaattaggactacaggtgcgcaccaccacacccagctaatttttgtatttttagtagagacgggatttcgccatgttggccaggatggtctcaatctgttgaccttgtgatctgcccacctcatcctcccaaagtgctgggattacaggcgtgagccaccatgcctggcctgaaattcacattgcttttatgtctttaaaatcaatccaggtgattgatacgtttgccacaaactactgggaaaattaagctctttaagctcttcctggctaaataaataggtaattaacttttggcatgacaatttgaggaagacactgatgttattaaaggttaccattacatatacttacaggggaagtggagacctcgttctagtggtggctgccactgtgtcagcatttgatttccagggtactagggtgactttctccaaggtccagtgtcagtggggagtggtgcttgatcagatgttcctctgatatggttctggttttgcttctttcatgagcctggtttcccaaatgtcctgcaactctgtgacccgtgtagtgagccactcaggatcccctaatgattccttttctgcctatatcagccagagcttgttcggttgctttcaaccaagaaccctgacaggtagagttaatttaaactttgaacatcaaatgatgctttctagtacgtgttaatgattgttgctaactgtaaacatctttcttatatgaaaccataacatagggaaggtccttttactttcaggaaaagacctagtacttttggaagtttatgcctatttctgtgaatgctgggtggatacattctgaaattatgctgtgtcaataacattttaatgacatatatttttgcttttgtacatttgtgccgctaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtatttttttttctctttttcttttaaactgcaagtgctgcccacgctaaattcattatttcagattgattgtcttttaaaattccctttgctgttgaactttttcttcagttttgcttttgcatcttctttatagtgttaaaaatggctttttcccttgctttttaaatctcattttaaaattctattttaaccaattttctttcccccagctctatcagagtaaatatctatttgtttatttggttcgatttctgagacataataaacatgtttaattttcctgaactgtgtattagtttcctagggctgttgtaacaaagtaccacagactgggtagctataaacaacaaaatgtattctctctcaggtctggaggctagaagtctgaaatcaaggtgtcagcaggcccgtgctccctccagactctgggtagaatccttccttatatcttcctagcatctagtggtggccgtggatccctggtactccatgcctagcacctgcgtcattctagtttctccctctgttagtcgcatggccattctattttcctatgtcccagtctccatcttcttataaggaaaccagacataccagattagggcccagcctggtggcctcttcttcactccatgatacttgtaaagaccctatgtccaaataaggtcacatgcacagatactacaggttaggacttcagcaaatcctactagcaacatattagaggaaatacttttatctcagttaaaacttttttagagatctcttctcaccttgctttggttctgtttttaaggaggagacttatttgggggagattttatgctcagttttaaaatggaattttatttgttggtagattatactaatttatttttcaaattccatattattttatcaaggtaagaaagtaaaatttatttcactcatagccccctgaactgaccactacttctatttcactggaatattctgccagacttctttctggatatgcatatatattattttatataaatagaattcttatattttctcttttacaaggaaattttttaacttaatatgttgggaagatgttttatataaatgactattactagacatctttttaatgattttattaaaatacatagttgtacattaatatctttaatccctcgggaatggaaatgaaattgtttccaatttttcagtatcaacaacactttgatgagcatttttgtaaattatttctttagaataaatgcctagaagtaaaattggtaagccaaagagcctataaatttttgataaactttgtcattttttcttacccctcaccaatagtgtatattggcagtctttttagagcaaaaaaggtccccaaataaatgatctctttttaatttacgtaactttgattaaggaagttgagcagcttttgatatgtttgttaatgatttataggttcttcttttatgaattgcctgttaatgacctttgactttgcctgagattcccttggttgttggggattttttttttttttttttttttttttttgtcgagacggagtcttgctctgtcacccaggctggagtgcagtggcgcgaactcggctcaccgcaacctccgcctcccgggttcaagcaattctcctgcctcagcctcctgagtagctgggattacagacgcgcaccaccacacccagctaatttttgtatttttagtagagatggggtttcaccatgttggccagggtggtctcgaactcctgtcctcgtgatccgcccgcctaggcctctcaaagtgccaagattacaggtatgagccatttttaggattacatatttttaggatctcactatctgttaaggctattaagttttcctcacatacttcttaaatgaattttccctgttttttactttttctttttaacttttttttttttcttcccgagacagggtctggttctgtcgcccaggctggagtgcaatggcgcaatctcaggtcactgaaacctctgcctcctgggctcaaaccatcgtctcacctctgcctcccaagtagctgggactacaggcctgcaccaccatgcctggctaatttttgtatttttggtagagatggggttttaccatgttgcccaggtaggtctcacactcctgggctcaagtaatcctcccacctcaacctcccaaaaatgtgttaggattacaggcatgagacaccatgaccatgcccagtgtaactcgtcttttaacttagtttatgatagcttttgtcagatgaaatattttttagtagcaaaatccatcaatcttatagtaactttaggaattaaaaagcaaacacctgttttagagttcctggtgcttcatgctcaatttttatttcacttgccttaattttaggatactagcatcaacacaatttgaacccactgcagctagaatggcctttccctgctttgatgaacctgccttcaaagcaagtttctcaatcaaaattagaagagagccaaggcacctagccatctccaatatgccattggtgagtctgcactcctgtgtattttctataggaaaatctactgattctctgtgacttgcactagcccagtgacagtcaacattgggtcacctgttttgttttattgcctggcagatcgttactaacttttcatttataacctatgcttttgtttcaagccatagttatatgtaatcaaagtaaaaattgcacctaaaaatgcaagatttcagtaacagtgccattccaggttatacatgctgataggagggaagtggtataagaaattcaggtcaggtttaaatattagtgcccttcacaaagcactttcaccctcattttctcatatgatcttttaaaatgattttaaaggtaatgctttgtcaataaggccatatttttagcatacagttattttctctaagttacatatactatatagtaatattcattatataatttgtaactgaatgtacaaaattgggcagacagaaaaagagaataaaagtaatcttttccaaatattatggtgctgaaggtaagtcatgatagatagcttagcttccagagggaaactattattccccaatctcaatgcggatgtggacagcattccctctgatttttaaaagtgactagaagatgaccatgccaaatgaataaaactgttcagtaagtgccatcatcctttgattctggtagtttagaaaagcatcagctgggccgtcattctgcagctggtatataacacctcctggaagcacatcctttgttcagagaaactcactggggatcagagtcagagtagaataggctttgcctagagtcctgagggaagaacagctttgtccctgtgctgaccggggaagcaatatcataacatggagagatactgagagccacagaccaacctctagtgtggtgcttctcaaccttaaaactctatacctacctgccttcataccataaggatgccttcctcaaacaagattcggatctcccaccccacgccagagggctatcctctgtaaaaatcactcttctgcaaattcctaccagccaagaacttctgtccccactcccacccttgtatatgaaaagacaagaaacaattatgctattttcctaatataaatttaatatacaggatgtgctttttcaaaatatagtcctctcccccagtattgtggtattactccctgggacagaagtgagttctttaattggtgaatcaaagttctaggagaataaaggaccagggatgggaaggagacaggagagagactgaaggaccaaacaggattagtggagaaatttgtaggctttcagaagggaggcctggagctttggaagcgccacaaagatgctacagtctaaatccatggatatccaggatccacttagtgaagataggaaaacttcttttttttttttgaggataggaaaacttctaatgcaatgttgtccctttggacgggaatacctctcactaacagaaatctaatacgagtagcctgacctcaggctgcagatattgagctgaggggagaacaatggggtctcaaaagatctttttggagaccagaaaaacacaatatataccattggaacattgaagcttttgggcatggggcagaaattaatcacatttaaatttgaattaatttaatcaggttattttcctaataattaacacaactcgagaatggaaatttttggccaggtgtggtggctcatgactgtaatctcggcactttgggaggctgaggcaggtggataacctgaggtcaggagttcaagaccagcctggccaacatggtaaaaccctgtctctacaaaaatacaaaattagctgggcgtggtggcacatgtctgtaatcttagctacttggggggctgaggcaggagagtcgcttgaactctggaggtggaggttgcagtgagtcaagattgtgccattgcactctagcctgggtgacagagtgagactccatctcaaaaaaaaaaaaaaggaaatttttgttgtaggtaggcagaagcagaatgcatttaaaaagaaaagatgatttgggatcctttatgagtaatcctaggctgggtagcagagttggtttgaatgaccaaatagtgaccagaagttggtggctgatgggtattaagaaggatgagggccaggtgaggtggcttatggttgtaatcctaacactttgggaggcagaagaagaggatttcttgaggtcaggagtccaagaccagccagggcaacatagcaagaccctatctctcaaaacaaaaaaaaaagatgaggtcagagcaatagaggtaagtattggattacaggaaaaatgcccgtgaccatggtttcacccagctaattctggctggttctttttccatctccgtgctttttattgctgacgtgttagactttcttctttaggggcagacctctaagactgtacctccatcaactataccccacccttactctctgattgcacttaaaaaggtgattccaatgaagcaaatgaagcaaatctttttttttttttttttttgagatggagtctcgctctgtcatccaggctggagtgcagtggcgtgatctcggctcactgcaagctctgccttccgggttcatgccattctcctgcctcagcctcccgagtagctgggactacaggcacctgccaccacgcccggctaatttttcatatttttagtagagatggggttccaccgtgttagccaggatggtctcaatctccttaccttgtgatccacccgcctcggcctcccaaagtgctgggattacaggtgtgagccactgtgtccggcccaggttactttcagttatacagcagaacagaagctcttttaggtactacagggttatatattttccccgttgcgtatatgctcaacagctcgacattgcattgccagataattctcaaacctgtatttaaggaaaagtggatcagccacatcttggcaaaactcacaatttcagttttgctttgtctcatccgtgttatcaatccacatatgccaaatgtggatttacagtgtattgtaaactttaaaatggtaagttgtatggtatatgaattatatctcaataaaaaagaaattgagtagaactgtttgacgttaatgtctaaattataattagacattggaaagataacttttaaagtaactatagaagcgtcattagacagggtctggctctgtcatccaggcaggagtgcagtggctcaatcttggctcactgcaacctccacctcccaggctcaagccatccttccacctcagcctccccagtagctatgactacaggcacgcaccaccagcaggactaatttttgtattttttttgtagagatagggtttcaccatgttgcttaggctggtcgcaaactcctgagctcaagcattctgcctacctcggactccccaagtgctgggattgatacacttttaatattatgtctgataattaggaaatttatcatgttcactgtattggataattggattacttgataatttgaattattctgattttaggtgaaatctgtgactgttgctgaaggactcatagaagaccattttgatgtcactgtgaagatgagcacctatctggtggccttcatcatttcagattttgagtctgtcagcaagataaccaagagtggagtcaaggtgagcctatgactgtcacatatggtgaccagcttgttctggtttgcttggaactggttttaaaactggaagtctgcctgagcgcagtgggtcgtgcgtgtaaacccaacataaacccaacagtttgggaggctgaggtggaagaatcacttgaggccaggggtttgagaccagcctggacaaaatagtgagaacctgtctctgcaaaaaataaaataaaaaaattagccaggcatggttccttgtgcctgctactagtcctagctactagggaggatcccttgagcccaggagtttgaggcttcaatgaggtatgattgtgcactccagcctgggcaacagagcaaaaccatgtctctaaacaaacaaacaaagacaaaaccaaataccaaaatcctggaagtcctgcatcctgggaaccttctcaatctcaggcaaactgggatggttggccagcctgttgtcacggatgctcatttgtatagtgaggttctaataacaacaacgtggagagagtgtggcctggcctgagtcatgatcctggcttcactgcagtcacttcactgactctctgaccttggccctattccctctgaaacttagtatttacttctttggaaggtataacttggactagatcctgcaatggtctctaaggttgcttctggttatggctttctgcagtttggaagtaaatgttactatctggcaggggatttctggctatggtaaggaagatagagcaacctgcttggaatacccaaaggctttgggccaggtacactggaatgctggagagaaaaatcttgtttcaaggcacacttgttcctcatttgggtactgttgcatagtgggcaacctattcaactgtgtgccgtagctcagaatgcaaacaggtttttctgaggggaggaagggatgctttgtttgaagataccttatgtgtttgtgctggttttcactgaggcctgaatagatggggattccctgctgaattgctttgtgttcctctagtgctgagatttcttattcttgtggaggtatctttacttaactggggatttgaaggtgacgcttgagactcggatgaagggaacattcttaattcagcagtgaaactatcagcaaaaacacccgcccattgctttgccacttatctgaatctcttagaaatgattattttagtaatgtctaatctatattaatatttttaattctttcatttctttaaacacattaagcatacaattatatatctgtgtctggtaattgttttatctgaattctttgtgtatctgattttgtggttcgttgtttctgctggctcttgcttatggtatcttgtttccttgtttgtattatgaattatgtttgtgagcttacgttgcctgagtctaaagtggattattccagagagaaattgtatttgctcttacagagtgtctgggagtacttactggtccagggatcactttacttgtagtttccttgagaaagggtagttatttctagtttacctttacattaaaggcctggcctttgggtactagctttatgcagggattgtatgtcctgttagactttctactttgggcaggccctggacttggtctcttaactcctgagtccttcaatgacataagaaccaaagctcaagtccagctgtgttgggctagtgccggcagggttaaagctggctgcagtgctctcctgacatcagagggtctaactgtcatttcactttggcttctaaatctttctttctcatttgccatcttataaacacatttaagaacactttatacatgttatccagcatttgttgttgttttcagaagggggattaatcaggaacagtcagtattaatgcaagaaatggaattcccaattattttctttaatattggcaaccatatcccacaatatgaagacattaatgtcagtcttctacacaatgtggggagagaagccagttaagatatttgaattcctttctgtgcctttctctttaggtttctgtttatgctgtgccagacaagataaatcaagcagattatgcactggatgctgcggtgactcttctagaattttatgaggattatttcagcataccgtatcccctacccaaacaaggtagagattttgcacagatattacacatgacatttgatgaacacagtcatagatttgtcattataattggcacatccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctttcttacacaagcccttaaaactattgtatgtttgattttttaggtatatgtgggtcttgggcatccaaaatagaatggattattataattgtttagtttttcaatttccaaactcctcatcagaaggttagaaatggagtcaagaggcctgaaaaggcgggcacggtggctcatgtcttgtaatctcagcactttgggaggcccaggcaggtggattacttgagcccaggagtttgaggccagcctgggcaacatggcaaaaccctgtttccacaaaagtacaaaaatattagctgagtgtggaggtgcactcttgtagtcccagctacttgcaaggctgagatgggaggatcacctgagcttgggaggttgaggctgcagtgaggtgtaattataccactgcaaatgcactccagtatgggtgacagagtgggaccttgtttccaaaaaaaaaaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccaggtataagctcattcacacttttaataaagtataaactacatttatattgcttctatgggacatataaggctatttatataatttttactttgtctttttttaataggaaaaattgtttctccaaagcattcgtttttatgtcttataatgcatgttgaactttttttatttttaccttgattaaatattggtcctgtaaatatatgttaacattcataaacttatattggacatctaaaatatacttctttctgagtgtctttgtttatggcttatgttgtgcttttagtggtttgggaacctggtcactatggaatggtggaatgatctttggctaaatgaaggatttgccaaatttatggagtttgtgtctgtcagtgtgacccatcctgaactgaaagttgtaagtagttatttatccttcacatttgaggttaatttgttgttttgttcaatattgctggaaaatattcactaatctttgattatagaacttataaaaatatttcactgataacttccttgacagtttagatatgaatcgtgttgcaaaaatgctagtgaactttcaagatataccacaaagacttatttacaaactcagttgtgaatctatgattgtttgtaaattgtccgattttatatttcttaatatcaaagaaatagaaataatggcagcctaaatgttccatttcattttcccaaccttcaggttgctcattgcagaattattaggtacagattactgatatctcaataggaccctacttgccaaatcaaatgagttatacttaaggtaactgcacatttgattgtataacaacctaggcttctggatcacaaatttattgctttggaactgctatatggtttattttttaaatcaccacatttaacttaagaaaatcacatatagcaaaattaaacttatgtaaaaatttttttatcctactccaatgattcttttcatttgtaaatatttattcctattttcatctgcctgtatacattatttaaaatatacatttgtgaatatttattactgcctattttcatctgcctgtgtacataattagaaagtacacatcaatattgcattataatcctaaatattttcttatgtttctacatgatctttagtaataaaaatgattatggatacatattgtcctgttgagctaatgtgctctaataaagctggttaaggttctccatttattttcattatgtttttaaaggtaagtatctttgctctaaaacagtacagacaatgattggaaatgttgaaattactatacagttaatttcttgttgtgttgctgtttggctataggcataattgtttcgtttttagattaatacgaaattttctttattctaaaggacttaagatgaacaaaatctataatgtttaactaaaatcattgtttcttgggtagcttttagaatatattaattctattttgtttcataaatattaggaaatatggaataggttgcccccaaaatgtgaagtatggacttcttgcctcagataaaatgtcccacctttgacattttttatctaaatgtaaatcataggtgatgttttcttttttctatctcaatagggagattatttctttggcaaatgttttgacgcaatggaggtagatgctttaaattcctcacaccctgtgtctacacctgtggaaaatcctgctcagatccgggagatgtttgatgatgtttcttatgataaggtaaaagtagattgagtataaggatacagtttagatactaaagttatacatactggggtggagaagttataggcaaggttgtggggttaaacccagattgaatgccttctctcttgacacgtgctggctggagtcaactcttttaggactaacttgcagtttggctcataaccctaaagattattttatgggaaattcttcatatattctttcttgggttgaaaattcatggcttacagaaactctgcttttattcatcattcaacaaataggtattgattgagcatcaactttgtactagacaaaaattcctgccctcgtgtagcttacttttcaaggccttcagcaatggttaatattgttgagacgcaaataattgtcttgcacagtgtgcttagtaacagagttgggaattgttgacaacagtttaatgattgggagattttatgtaaaatccagatttctagcttctcttggggaagaaaaaggaggatttggccactgtatgttctttgcagcataagctggagctaagttgttgttctctctttgtaagatcaaggctctgcttttccactttccctgccattcccaactgttctattgtcttctcaccgaggctgagagtgtgttgccagttaccattgtgcttggctgttgttttaccggtagcaaacagaaaagtctttcttgcttgcatgtttccattgaaagtccaggggaaaaagaatgtaaaagagcattcttcttatccttggactacttcccttatttatatgccctgtcatgtgccactggaggcatttgagtttgtgactcaccatccgtggtaatgggagtggaggggaaaagagccctttaccaaggaatacagggtgtctgggaagactcttgttccctttctcattgtgactccagctccatcagccctccatgctcaaggctgcctgggctccctggacatatccacttttccttccctggcatctacctctgcctccatctctagtgctccaccccttgttgtactggcctctccttagtcctgccctggaatggcagtgggagagccaggtagtagctcaaggtccaatgtttaatctgcaccattatccccactcacatgtgaacaaagggagttggcagatgatgctaatttgccccatcgggaggtctggctactgatagaaaataagggcctcagtgggctcagagcataagcaatcacattagacaaatctcctgcctaaacaggtccaggtttaacctgcttactctgtttcacaaattgccagacattaacagtgttcctgcagttgcgttttcaaagaaatgtgttttattgcaaaagaatatgtgatttcagatgagactgcaatgaaactatagataacaattatttctattatcttttcagggagcttgtattctgaatatgctaagggagtatcttagtgctgacgcatttaaaagtggtattgtacagtatctccagaagcatagctataaaaatacaaaaaacgaggacctgtgggatagtatggcaagtgtgagtatgtttttgaatatctctgcatttgggattgacaggcttatcatcttgttttgttttccctgcattatgttaatccctctgaggagaatcattgttttctatagaaataagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttcccttttaaagcagtggatttatgacatgtttctatagcagattacagctgcattgtagcagtcaaaaggatatgtcagtcatttacagagctctgcatttgtacaaagacaatggcactgagcattcttgaatacttgtcatgtgtcaggcacatgttaagcacttatatgtattatctcctttactcttcataataaacctgtgagctgggtactattactatccctatttttaaagttgagaacatgaaatacaaagacatctgattggtaaattgcagagcagagatctgaatttagatctaactcatgtttttaactgctaagctataaagtattcataacatcaagtcacaaaacagcctgagtctctgttcatctggacttgtgggatgttttcagaggaagctgagggtgagtctggagatacaacagaattttttgtttcttttttctttttatatgtttactttcttggcttttttgttcctagagactgctttattcagtagtttctagatttgtcctgtggcacattttatctttttactaattcttttttttttgagacagagtctcactctgttgcccaggctggagtgcagtggcgtgatctcggctcactgtagcctctgcctccccggttccagcgattctcttgcctcagcctcccaggtagccgggattacaggcacacgccactacacccggttaatttttgtattcttagtagagatgaggtttcaccatgttcgccaggctggtcttgaactcctgacctcaggtgatccacccaactcagactccgaaagtgctaggattacaggcatgagccaccgcgcccagcctttactacttcttaaatcatttcttaaaagcttttttagtatcaaaaaacagctccttttgagttcccactatttgttgagtgtgggtcatctctgtgttctcactttagaaacacaggctcttgactgaacattgtttccaccttgcttgtccaaaaccagcatagttaggtaggtattgaaaacctggcactttctctcccttctcttccttcattcattcacatgcctgctttgtgcccagtgttattgccagccccaaagtgtgcccggcagaactaggtatgctacctgtcctccagacacgtatgtgtagtggaggaaaatgacaagcaaacagctggtgctctaatggaggtgtgatggctggggacatcacactgagaaagggatcagaaagtgctcctaagaggggaggttggcaactggtagcggctgtttgagcataagctggtgttctctcttttcttagagttgggttaaatgggtgatgtgtctgcctttttgtgtacacaccagcattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtaatgctcctagagtaaaatttgttttgttgtctaggtaacatctgccttgtaggatggaaccttgcttttgaaataatgcccttaccactattgctaaaatatttcagctgcatctgtgtatcctatgaagttgacttatactccctgcccccatcttcccagtaggattaaggaggctttaaaccttggttattctcagtaaaggtgacgatgtaattactttaacattctcatattttgtaatttgatatgatggtaatttctggttactggcttgaaatcaactccaacctaagcaactgctactagattacaatagtgcctagcatttggttggagctgaggacaaaagaatttaggtgatttccgagaatgatgagagactcagttgtcttcttctgagttagatttggaacctgtttgtcagcttaatgctatagaagaatattattagaaacaagatgctgcaacttgattgaccctggatggataccgttaaaaaattcttttatcttgaaacaatttcagacttatagagaagttacaagaataacacaacaaattcctatatatcctttacctagatacatgttaactctttactcctttactttcttcacctccctctctctcttgctctctctctctctctatatatatatgtatatgtttgtgtggatatatgtgtgtgtgtatatatacatatatatgtgtatatatatacacacacatatatatatataatatatacacctccctcccccatcttcccaaaaggattaaggaggttttaaatcttgattaatcgatatccatctatctacatacatacctatatacatatgtctgtatgtatatacttggcatatgtttttctgaactgtttgacagtaaattggtgacatgattccccttcacacctaaatgtttcagcatagtattttctacaaaacaacatttatggccggtcacagtggctcatgcctttaataccaggactttgggaagccgaggcaggaggatcacctgaggttaggagttcgagaccagcctggccaacatggtgaaacaccatctctactaaaaatacaaaaattagccgggcatggtggcgggcgcctgtagtcccagctactcaggagggtgaggcaggagaatcgcttgtacccaggaggtggaggttgcagtgagccgagatcgcaccactgcactccagcctggacaacaagagcgaaactccatctcaaaacaaacaaacaaaaaacaagaacattcagttatataaccatagccacagtacaattatcaaaattgggaaataaactttatataatactattatctataaatcccattcaactttttccaattgtcctaaaaatatccttatagcaaaatagaaaataaattctgacttaggatttaatacaggatcacttattttatttagttgttgcatcattttggtctccatttttttctgaaacaactcttcagtcttttttgggcttctcgatattgacattttttgaagagtactggccagttattttatagaatgcctttcagtttggattttctgctgtttctccatgatcaggttcagcttacatatcattgacaggaatcccaaggaggtgatattgtgtccttcctaatatactattcaggaggcacatgagtcctgaagttaggcctctgagatgcaatcagccaatcactgtaaaaaggctttcagggttcacgtgagtccaaattcttagctctactcaaggagtccaagaaaaggaaatagtgcccgagctgacactccctacaaagctggaaaacagactggggatgttttgagagcttggctgtagcagttttggtactatcttgttctaaactaaccagtgcctggcacatgataggtgatttaataactgcttgttgaattgaatcaacaaatgaacaatccacctctcctttattttaggtacctgtggcatgttccattgacattcatcaccagcaaatccgacatggtccatcgatttttgctaaaaacaaaaacaggtaatttattttggaaactactagttaattcaaggaggaatgtgaaaatgtgtaggattaaagtgctgtttcttttgctatttatcttggttaaagcaaaagggatcagattgaaaatgctttctggtttcaaagaagaatggccaatatcttgccagatagagattatagctgaattatataatgctaaaaaggagggattaccagtgaacattcactattactttgttaacattactgggttatatcatatgtatggccagagatgtagttgccattcttttcatagatctgtaaatctcacaaaattgatgtctaaagctagtgttagcttttgtctattgagttgctgttttctggtttctgagagaaataagtgatgttttcaaatttttcagtattaaactcttctctaatttccttgcccaatcttggatgagaaaagctttcttcaggcaggggagcaaatggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcaggtaatacacgctgcacaaagtcgcggtttatttctgaaagcagctgttattgttcaaattcttgatttctaaagacaaaaatgattgattgataacaagaagttgaaaggtgttttcctttaagttcttctaacaacccaagattgcttttagtcttataattaacctcctgtctgtgactactaaggcacttgaaggaaggaatctgtatcttaatctttctcattaataattcagatcatactgaggcggaagtgtagataaccaggagatcaacatcctggcgaaactccttgccttgtccccgcggcatggtcccgcagcttcttctggccccgctataccggatcaggtttctcccaccactgggtctttataacagccttgaagtcttcttagaagactaagtgacacaggcccaagttgtttgcattacatttcttgggttaaagaagggatttttttttctttcctaaaccagatacctgaactttgcagcatctttatggaatatagctcataaaatgtagcccaaccaaatgatctctgagtgtgtgaagacagaattaacactaccctttttttttcctcccccatgacaatggtttttaaggaaatgctcccaaagcctaaaactcaaacttcttcaacatgtaggcagacctaaagtcctaagaggaagcatgcaggtgggaaggattatctctttctcctcatacccgtatccttctggcctaaattttgagtgccttctggttcttctcaccaccatactgggcctcctgaagtgagaaaaagcaatgggggagaaagttatgggttgcttacctagctgtttctttctgcctaaaaaattcccctctgtagaatatttctgcttgagccttagagggcttcttcttttttattttttaacttatataatatataccctaccactgaggtttttaacactaaccctctgtaatgaagggtttctaaggatatgcagtgtctttgaaatggagaagaaaatgtgtttcctccaggaactcatggttttgaccagatgatagtctgtttgaccaggcttcctaaagggtctttgatggaaatcccttgcttactctagaagttcaccactcaatccagtgtttcacagggatagatgctgatgtgcttcctttccggcttatccacgttagccctagacgttactgtttgagaaacttcctccctagtgtaaacatgccggatgttgtgttatatgtgatagaaaagagacttatatagtagttatctatctgtttgtttatttattttttggagatggagtctcactctgtcgcccaggctggagtgcagtggtgccatctcagctcaccgcctctgcctcccgggttcaagtgattctccggcctcagcctcccacataccaagtacctgccaccatgcctgcctattttatgtatttttagtagagacggggtttcaccatgttggccaggctggtcttgaactcccgacctcaggtgatccacctgccttggcctcctaaagtgctgggattacaggcatgagccaccgcgcccggccgtagttatctatttataagggacatttatatctgattgcttgttttgctagaagattaaaatatattttgaagcaaaaagttgacttcccggatttacttttaaaccactaaccacagtgtctcttggtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggtaaaagcctgaaataaaagttatgtaattattatttgtgttaaaaagtgttaatcattgtgtgtgtatgtgtgtgtgtgtgtgtgtgtgtgtgtgtgtgtgtgtatctttatatacatattaaggaaaagcaaataaatattagttcagtatttagatggactagcaagattttggttttatttggcactaaaaataggaatggcattcttagactctatttaatttgcatggatttgttatttccttcctttcacaaaccttttatttcattttcctttcctattacaatggctgacgttcagattttctgggactcttcatggtacttgaggaagaggcacaaaattgttatgcttggcaaaatgtcctgaagtcttgttgcataatttgctctcaaaatttagtcatgtaaactctctttgagtttgttttaaaagtcgcaattcatcctgactttaagtagatggatatcttataaaagtttgttatgaaaatatgaaagtcattcatcattatttattgtttttggcccttttataattaaacagtgctgcatgatttatacagtaaaagttagattatgctttaaaaattagcccccatcatctgagaccataatggattatattaacatgaaatgacctgtgacaatactggtccctgtttccctgtacaacgccctcaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgaggtcagtccttactaaataaccaatttgttgatgtgaagggcatcttttctgttttccatcattggtactaaacattagggaaaacaaaaagtttaagtgtctcccctgctgcccttttctggaaaataaattgctttttaagatttatctatgtatctcgtaactttaagaaatgctaggagggaacttctatgcataaaagtcaaatatctggggagttaggatggtatgggaataattctcattttgtataggcaatgcaaaatcttattaaacggtgacagccatgccatagagaaacacatgcattgtattttatagtagtttctttgggcttccaaattccctgacagggatgcatagtaattgctgacactgtctaagcaaggtaggattttaccgtatctggaaatccctattcttgctacacttcagtcctttttacatttggagcttaaaccccacccaggaaacatttatgccaacaacctacatgcttcagcttaaagaaatccaaacagtggtcctactgccgtcctgacttgtgatcatggtgtaaattttgaatatagtttgaatttcttttggcttgaaaggtgatcccctatggagtcacccagcatcattaaagtatttaaatatgtaggtatttataaaaatggcatttcacatttttgagaaggctacttaaaacctaattttagatatttttctcttgccttttttttataaagtgtaactaggccaggcgcggtggctcacgcctgtaatcccagcactttgggaggctgaggtgggtggatcacgaggtcaggggatcaagaccatcctggctaagacggtgaaaccccgtctctactaaaatacaaaaaatgagccgggcatggtggcgggcgcctgtagtcccagctactcgggaggctgaggtaggagaatggcgtgaacccgggagggcggagcttgcaggaaccgatatcgagccacggcactccagcctgggtgacagagcaagactccgtcctaaaaaaaaaaaaaaaaaaaattgtaactgaaggaaatcagtagtttttgtttatatttccaggcatgcttctctgatcatggggaaagttcagcagttcatagttagtcaccattatgcctctaaacatacttactgcacctcagattctcaccgagtgtgttcctttctatagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggtgagtccgtcattcattcatgttcatgtggccaagggaaattagattagattagatcattctggcatctatttttgttttcttggccaggaattgcctatcctgctgggaacatactgcaagtcagcacacatctaatgagaaaggcaaataattagggagaaccaggtgttaggaaaaatatttaaaggtgtatacatttgtgcatctttaaaatgacaacatattaaaaatatttactagagctactcttccttaactattcttttgagcaaatgagagggtatatgagaatgggtgttatgaacactatataaatgttagtttttattatgtagctatagtgggtttatcaggattgtggttacccatttatctttttaacctttgttactggcagacttttttttcttttacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaaaaaaaaatctatatatatatttttaaacataaatgaaaattagctaattaatatggggtagacaaaatactttgagggtgtggtgagttagaaatggattgtcatttagaagttatttttggatgctatggtgttgacagcagcataaatcagttgcaattaaactagtgaaaactgtgcctcttctcagacacgttaagaggtcttagctctgccagtaaaaaccttaggacttgaagaaaattacttgagacaattagtccttgtttaaggatgttaaaagtgggcactgaggtataaatgactgaagtggtcatccagctgttgctaaagaggcaggtccggaatctaggttctttataaaccatccaagttcatggttccctgtcacttattatgtaaccatctaccttcagaaagaatttcaggcagctttaagatccatgtataaaagaaatgttaaaatgaaggacaaaaagatacataatggacaggtgataaccatgtgagggacttatggctgaggataattctcgcaattgtcccctgaatttatcacagacattcctggaagtcaaggaaaaatgaggaatcagtatgagttattctcattgtctggtaaaagagaacatgaagcatacacattttctacaaaagcagacttttcttcagtcctaaactcgaggactttgatgtgtgggccattgagttctgtggtgtcccttctataataaggtttcctatagtaaagttgtggaacaaattttacaaggctcttaaactgtggtacatttagataaaagctgagaggctaatattaatttttttaggagtggttccattgtgtagtctggttacactattttctagcttgagatggggagagagctttggaaatgaaaaagaatgaagggttgttacagtctcgtagcttttttccagttttcagtagcctcatccaggcttgtaaaattaacttgcatataataattcaagcttgaactccagcgaggtctagagcagagatactctgtctgatgactgaagagatgtccaaagccttgaccagaaaggtagtcatctatagacaagatctatagcaacaaagcatttcattcattcacttgtattctcattaattcattcaagacatatatgccacacatggttttaggttatggggctgtaacagtgaacagacagacaaaacctttgctgtcacggagctgaaatttctgctgtgggaatcagacaattacagacaaatcaaccaatgtcaagtagttacatgctctgaagatgaataaggcaaggagagtgattgggatagagggttggtgctgttttataggatgattaggagacatttgagaagatatcgaaggaaatgccaacatctagaggagtattgtgtgcagaggaaatatcaggtgcgaagatcctgaagcagggcatgaaaagtaaagagcccgagatgttatcataatggagagcaaactacggacatataaaatacgggagtcatcctgaatcctttcttccccagacatctaactacgcaagtcctgccggtcttccctcagcacatgcactggatcttgcgcacttctctctgctcttacccccattcaatcctttctcatctcttgccttgcctattgcaatagtgtcctaactggcctcccccttgccactttgccaatagcaaaacattttccacattgaagactgcaagtcagcccataactgaccctggcttcttgaaaccctgcctattgttcttgcagtaaattccaaatccctccttcccatgtgtccatgaccttgaagacctggcttctgaggacctctctggtgccaattcccacaggcgctcctggcttactctctcataacactgtagccactcagcctccttctgctcctgggctaccacatgtttctcctgtctttaagcctctgcactttttattctctctgcctggcttgcccattccccaacttttcactagaaaggggcattttatctttgagaggtctcggctcagatcaccttccccaaaaccatgctgttcaatgcaggccacatctcctcagttactagcatacccctggcatattttcttcatagcagtttatttacagtaatcatatttactgcttgtataccccaaaagactgtaagctccatgaggggaggatgcttgcctgattcactgctgcatcctcagtgtctagcacagtaattacagcagagggatgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaactttatgtggattttatcttgagacaacaatacatgaattgtagattaggataaaaaaaatggcaaggtttgggtcttaccgccataacttgctaagaatcccattccccacagtgtttctataataacatacaaggccaggcccatggagaaagacagcacttacgtggtggaaactgttttgcttggcaaagaaaagactctgcacattctgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgaagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttccataaagccagacgctatacagtgcaaaggctaatgtggcaatagctctaaagacacagttgctgctcaggttttatgtatagataatagaaagcacagtttactaacacagtaaaccaacagagttcaagtcagatgagtaccctaagaattaattagattttatttcttatgctcgaaatttgctacacaaggacttatctaacctttattttgctctgttgctgacttgattcaagtctcagtgtgttctgtgctgactgtaagatgcagaagtcctcacacctggcaaagaagagttcaaactgaaaaggggtttggtgcttcctggtttgtccaggttacctgttattaatttattattagcagcccaagaggagatatgtgcccaatgtacaatatcttatgtttgacttataaacattatcccaaagcaacatcaaatacagttcaaaagcccaagaggaaagggggtaataagaaatcagaacactgaagaatgtttaaaacattgttttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccagctgaagattttacatgcagataccttaaaaatttcaaataaaaaatgcagtgaatcatttaatatgtaattttcttgttacagacatagtaaatataccacttagcaaaagcattgtataacagacagaaggaatttcctataagtaaacatgaaagtggattaatagaattttttttaattttgggaaaaatgttagagcagttctacctaatatagctccttttttcctaggaaataaacatggatcatggtgagagagctgaacccgatttaacctatactttgatttcttttaggctttggtcagtaagtgcttgtatgcttttaaggcttacattaagccctctcctttctgaagattaagataagggcccagttctgaagatctcagaaatcccttcaatctgtccagtttcttcagcaattataaattagaatcaaacacagtactttactttccaaaataatgacaaataaaaatggccaatcttttcctttgcccttgttcccaaaaccctgtaatttccaccagactctaaagggtacttctccccaccccaccatgtattggtattctggggaatgccaatgtcttcaggacatttcgctaagttgtaacatgctaattttgctttgccacaataacctgcagtaatgagcatttggatttcaaagattcaactagcctcagatggtcattctaagtgcctggcctaatatttttaaaagcttttaattataagattaaggtttttaaacatttcaatagcaaactcatcccatttagtgctttcagagaatgaccaattactctgtagatcttgcagtatgcatttcatgccaatactgtaaagtgagcatgaattactcaagaggtggacttcacttctctcatctataacacataaattggcagaagatacagttgtcttcatttacaaataaacacccaacttaccagataccttaacttgtatttctttagtcatcttttggcttggaagtttcctctgttgtctaaaagggaaagcaaaaccatccgtgagctttcttttctgtattaagtatgaggagatggccttctcagaattaggggacaaaagatggcagtcagtggggaaaaataagatggtcctttcagtttctcttcttcatctggccacaatattgtgagttcttcctcctcaagcttataagctaaaaataaccttaagtgatcctgatcctaaatgtatcactctcagctttatttttttaaggctagggtaggttataaaatatgcataggtgttcttaaatggcaatgtttcattctgtggtgatccttcctttcctgtacatagggtcatggctgtccagtaaatccactcatcataaagggttattatgctttctattatttgttaaagggctgattaagtacttcgtataactgaaattaaataataggcaaataagtatttaaactgagatataatggcataactgccaattatcaatgctgtttcctatatcccttaagggaatctactacaggaagattttaatatattgttttaaaagctttggtgtaactggactattgtctttaaagctacacctttaactcctccttatagccaggggatcatagtaataatcatttaaatcatatgttcttggaattggaagggacctagaagttgtctaatccaattttcatttctcatcacagcttgagtaattttaataataggaagtttccaacttccatgttctaaaatctatataaaccacatactatggtggtattttaattagggcaagaaagacaggcaaaacacaggcaaattgggttgtgtcaagaacattcatttaggattttaaagcaccagttacttaaaaatatatgtatttatacaaattcaattactttaccaagcgatgctatgggatagatagtactttaagaaattttattctaaatagattccagtaggaaactaaatgactgaaatgataaaccctactctgtgtaactgctaaactaatttgtagtatatttactgctccatttacctttgctgaatccttcgctttacctccattcttaggtgctttggagctggaagcagccttcttgcacttatcctaaagcaaaggaaatgtaatgaggctatggctatcaccaatccatctagcaattaactaggctgcagttaaattaatccagaccattctgagatctccaatttaattaaataatggaagactttgggtgttttttcatgattttttttgaacaacggtgtcagagaattgtttaaagcaggagggaaaaaggatagaaataaggagggaaatgtgggtgacattgatgctctaattcccgtggtgcctgactcacccagaccttattttgctaatcaaaacagagcttgtcaatagataataaatgtcggcaagggtgtggagaaaagggaaccctagtacactgtcagtggggatgtagattggtatgggctatgatggaaaacagtatataggttcctaaagaaattaaaagtagaactactgtatgacccagtaatccctcttctgggtatatacccaaaggagatgaaattatcaccttataaagatatctgcactcccatattcactgcaacattactcacaatagccaagatatggaacaacctagttgttgatgaatggataaagaaaatgtcatgtatatatacataatggaatattattcagccttaaaaaacgatatcctactatttgtcacaacatggatggacctggaagaccttatactagatgatataagccagacacagaaagaaaagtgatttcacttatatgtagaatatatataaaagaaaaagctcaaaaacacagagaataaaacatggcgaccatggtagggaacaggaggaggaaacagagatataggtcaaaggatacaaaatagcagatatgcagaatgaacaagtgtagagagttaatgtataacatgaggactaaggttaataaaattgtattagggattttgttaactaagtagattttagctgcttttgtcacaaaaagtagttgtgtgagaatgatagatatgtaaatctgcttccctacagtaaccattttattatttctatgcatcccaaactaccatgttgtaaacctcaaatatacacaataaaatgtatttaaaaaacaaaatagagcttgtctcgatcaggactggcttttgtgtaccaaaaggcaaaaaaaaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatagaaaaaaaaggaaatccacaaaataatactgttttgggggcagtggaattataggcattttttcttttcttcattttcaggttctctatatcatcgtttgattcattctacagtttaaaaattgtaagggccaggcgcagtggctcaagcctgtaatcccagtactttgggaggtagaggttggcagatcacttgagcccaagagctcgagaccagcctggcaacatggcgaaaccccctctctacaaaaaaatacaaaaattagctgggtgtggtggtgcacgcctgtagtcccagctactcaggaagctaaggtaggaggattgcttgagcccaggaagcagagatcgcagtaagctgagatcacaccactgcactccagcctgggctatagagtaagaccctgttacaagacagaccgatagatagatcaatcaataaataaaacttatatgtatgtacacatacacacacacacatttcaaagagtgaaatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtggaattgctatcttgaggaatactgaatgcaagcaaggagaattggttcctgtaataggagaccctgaagctgacactgctatttaaaccaggaatcatcttactcaccaaaatgaatcagtacagaaagagaagggtgtaatttggtcttccttgtttcttatttgatgaacaggcatggaaagggttatttatcatctaattgactcaaaaattagaaactaaataggaaagaggtgggggacaggcctggttgacctacgaaagactggcctctatcatgtgggagacaaaaggccagggactttttggcagagaaacaggatttgtgattgggaatattgctttgcctgtcttcacttgcaatagtgctgatgatgatgcaggagaagatagggagaccccaggtcttggagctgccttattaattttccctattaattatcccaacaccagctccttttctgctctccttaaacagagattgcttcctttgaaatcctatcaccttagtcatttttatagccttttcttgaaagagagaatcacatttcttggatcactcttaagcatctgtgagtgactgaacagtattcaaccctgtttataccacagagcctagcatatgcatatataatgatattggctcaaataaatatttacctgctggtcggctttggtgacacattagaagcagtcagtcatggtatgttttatgctattgtaaaggagtatagctactatttatttcaagggaggtttgaatttaaagatcttggtagcataaatccgatctagcaatttgcctcagtttacctgtccattatcatccaggagatgtctgtattcaggtgggatagtgtcatctctttctccaagcttgtctctatgttcagctttagctttttcctatatcaacagtgagcagatagaattaatattcatttcctctttcacttagaaaatacattgtcaaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggaaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctccgctggtatctctgtcacagattcagtgaccttcccctccagtggagtacagattgatttttctatttcattataatttcatgtttaaaatataggttaagttcacatcaatattcctatgacaatgacagagtcaagacccaaggattaaaatttcactattagtgaattttttttttttttttttttttttttacctttactttatcttccattggtttgttctcatctgggtcaggctgcctttgtcctagactgtcagagagtttatccaaggcatcatcgaggtctttgtcactctgctgaaaagtaaataatgctgaattagtcactcattagccaaactgtatcagaggcaaattagcccaggaactccatcttttcaggagggaacctgtttccttggaagaaaaagacatctggggctggggcaggggagtagacagggtcagagaagagaagcctaggaatggaagatcaggagaagagcggcagtatctgtcaccctactggggttggagggccagcaccttccacccaaccctgcccatctcttggtgaagatcccaccaggttaaggaggtcttagtggcagcctcaggagccatatccagtgggtgacctggaggtcacataaagggtccaaaagcaaatgaaccaatcatgtgtgcctttcatttagaaattaaacaccattagaaaactggatatgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggacaacaatatcactgtaactaagatagcttatttcctctaacatttatttactgtatgattcaggcagcttatttaacccctttcagcttcagtttccttggccgtgaaatgtgaataatagtagtacttatactcctaagttgctgagaaaagtaaatgattgaaaaggcatttaaaacaatactagttgtatgttaggacccaacaaatggtaaattattattagtattattatagcaaaatccatatttttcaacacattgcattcaaaattccacctctaaatgaattcaattaaaatgtgtttaatatctacattgtataagacaccatgctgaactctgtccaatactgtatagaactttccagttgattttcaaaatgttttcacatacactatccagttttatttgatgcccacaatggttctcagtgaactaagcaggctttttttttttgaggtaaaaagctcagggaagctaagtcagttgcttgaaaacaaattgttaaaaagtgaatagaacccaggtcttgggactgataaagcttttccctgtcatgcttagtcacatccatgatcttctattttctttgaagcagttttcctgttggagtgattttattacacagatctttgaaatcatgtcttcaaatgctttcagtgtatgtaacactgttagtaacaatctaataatcacagcaaagaaagctcccgtgaattatcatggtttatttgactcttcgatttcctaatatttttatctaaataaagctttataccttgttttagtgacatcttcaaataaaatgttaactaaaaacaagcctctctgatgggaaatgtgatcagagaagtgtcattgtaaaacctacttcttaaaggcaaaaaagtttttgattgcaaatgtttactgatagccttcatcagggcagaatctctggcctgaatattaagaactgaagtgtaaacggcagcctaggctattaatgattcttcctttctgttgcatggggactttcttcattgtgggtgtgtttacatacacacatgcacatgcacatgcacatacacacacacggggcattttactggttttaagtgctttattataatccaggattatagctgctaatggtagagctgcccggggccaggtctgggctttgtcatttgtgcctctggatattttcagatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 2 - DNA, 47291 bp, Homo sapiens
  source 1..47291: mol_type = genomic DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctggtggggtgggatgcgcgggccgtgtgtgttcttaaggtcacttccctccctgcttctcctgttcttctggtcagcaattctctctctccccttcgctctggctctggctgggttttattcagataaagcacctctgttgacgcaaattaaaagtttcctatctgggtgcctcactggccaggtggtcctacaaagttaattccatgaggggaagggggagagcacacacttcctcacgcttttggatttctttgtgtaggctaggttcagaaagaaattatctgtttcctattaaacacccagaggattcgctctgaactcaggacgtggtcaacaattaacaaaacaacaaaacaaaacaaaacaaaacaaaaaacttgaaaattgggcacagttgtctcttgcctgaggatttttaattagtataagtagcacattttcaggtgcggcctgaatagaaacattctagtacttttttttttttcaaattaatccagcatttttattatttaccaacagtgcttgttaatttcattgttcaggaaattctggaagaacctcaattacttcttgatgatctatttcatatactatagtgccccaataaaaggaagggaggcagaggttgcagtgagccaagatcgcaccactgcactccagcctgggagacagagcgagactccgtctcaaaaaaaaaaaaaaaaaaaaaaaagagggatcttggtgaagctgaaaaagcagggagtttatactcacacagatgtggattgcattccaacaagttgtgtgaacttagcaaagttacatgaatggttctttgcttcagttaccccaccttgaatgagaataataggctattagagagagtgagcatgtgtaaagtgcctggcactttggaggagcttagtaaatattagttctttttcctccttggcttctattcctttaagtgttagtggagtgtaacttcaaagagaattgtacttctcttgggaagagctgcttatattgagtagactactgtttttgagagctttctttttttttaactgcctccctttcagaaaattgttagtaaaaccagaccctaggagaccagccagaaccatgaaatgccatgtttcaaactggaacacttactattggaagcaaagccaaacaagagctaatttttcaggggaagagccaaacacacgaacatgatcacagaatcttggatgtagcctacagtttgggattaataagagaatttattagtgaagccctttattcactacatggagtttttaccaagccccactcatgcactgcatcctcgttgagacataactgtttctctttggacccctcatggacccaaccctgcaaagcctctgatccaaggtcccggtaccaaccccttccgcagcacatcagcctttctgtcagctcataacgagttggaatttctagatcttctctggggctgttggagaggtctcggggactttcagagtccttacatgcttgaacctgccaccttcacagagtcctctggatcccgtcttggggcaggggcgatgctcattaagctgttgctgccagtaattccatatggaaagcaaaacacaagttccatttactctctagttccccaacttcaagggcaaaaaaatgttctccctgttcacacttcctgtctcacctgggtggtgccttttgaactgggattatgagatttccaagactctctctaatgtgtaggtatcctttctgtttagcctccagattgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagttttttttttttttaaaaaaaaaaaccaaaaaccagaaattaaacaatccgtaaaaccataccccgatcttatcaccataggttccagtttaattgttgtcaataaggacccaggcatcgaaaattttaaaagcttcccaggttacattaatatgcagccagagttaggaaacttgacatctcagagagggagaattccatgtactgtgaacactttgagggatccacattgtaagcttgctacttttcccaactggaacacgaggagtttgggccaatcacttgcattcacctggtatgggcccctcttggcaaacacccattagaaaggtgcgtttgtataaaagaaataaaaacttatgtttgatgcttggggcatggtttgccaacttccttaaaattcacattgccttttttttttttttttaaagacagagtcttgctctgttgccaggctggagtgcagtggtgcaatctcagctcactgcaactctgcctcccaggttcaagcgattctcctgcctcagcctcccaagtaattaggactacaggtgcgcaccaccacacccagctaatttttgtatttttagtagagacgggatttcgccatgttggccaggatggtctcaatctgttgaccttgtgatctgcccacctcatcctcccaaagtgctgggattacaggcgtgagccaccatgcctggcctgaaattcacattgcttttatgtctttaaaatcaatccaggtgattgatacgtttgccacaaactactgggaaaattaagctctttaagctcttcctggctaaataaataggtaattaacttttggcatgacaatttgaggaagacactgatgttattaaaggttaccattacatatacttacaggggaagtggagacctcgttctagtggtggctgccactgtgtcagcatttgatttccagggtactagggtgactttctccaaggtccagtgtcagtggggagtggtgcttgatcagatgttcctctgatatggttctggttttgcttctttcatgagcctggtttcccaaatgtcctgcaactctgtgacccgtgtagtgagccactcaggatcccctaatgattccttttctgcctatatcagccagagcttgttcggttgctttcaaccaagaaccctgacaggtagagttaatttaaactttgaacatcaaatgatgctttctagtacgtgttaatgattgttgctaactgtaaacatctttcttatatgaaaccataacatagggaaggtccttttactttcaggaaaagacctagtacttttggaagtttatgcctatttctgtgaatgctgggtggatacattctgaaattatgctgtgtcaataacattttaatgacatatatttttgcttttgtacatttgtgccgctaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtatttttttttctctttttcttttaaactgcaagtgctgcccacgctaaattcattatttcagattgattgtcttttaaaattccctttgctgttgaactttttcttcagttttgcttttgcatcttctttatagtgttaaaaatggctttttcccttgctttttaaatctcattttaaaattctattttaaccaattttctttcccccagctctatcagagtaaatatctatttgtttatttggttcgatttctgagacataataaacatgtttaattttcctgaactgtgtattagtttcctagggctgttgtaacaaagtaccacagactgggtagctataaacaacaaaatgtattctctctcaggtctggaggctagaagtctgaaatcaaggtgtcagcaggcccgtgctccctccagactctgggtagaatccttccttatatcttcctagcatctagtggtggccgtggatccctggtactccatgcctagcacctgcgtcattctagtttctccctctgttagtcgcatggccattctattttcctatgtcccagtctccatcttcttataaggaaaccagacataccagattagggcccagcctggtggcctcttcttcactccatgatacttgtaaagaccctatgtccaaataaggtcacatgcacagatactacaggttaggacttcagcaaatcctactagcaacatattagaggaaatacttttatctcagttaaaacttttttagagatctcttctcaccttgctttggttctgtttttaaggaggagacttatttgggggagattttatgctcagttttaaaatggaattttatttgttggtagattatactaatttatttttcaaattccatattattttatcaaggtaagaaagtaaaatttatttcactcatagccccctgaactgaccactacttctatttcactggaatattctgccagacttctttctggatatgcatatatattattttatataaatagaattcttatattttctcttttacaaggaaattttttaacttaatatgttgggaagatgttttatataaatgactattactagacatctttttaatgattttattaaaatacatagttgtacattaatatctttaatccctcgggaatggaaatgaaattgtttccaatttttcagtatcaacaacactttgatgagcatttttgtaaattatttctttagaataaatgcctagaagtaaaattggtaagccaaagagcctataaatttttgataaactttgtcattttttcttacccctcaccaatagtgtatattggcagtctttttagagcaaaaaaggtccccaaataaatgatctctttttaatttacgtaactttgattaaggaagttgagcagcttttgatatgtttgttaatgatttataggttcttcttttatgaattgcctgttaatgacctttgactttgcctgagattcccttggttgttggggattttttttttttttttttttttttttttgtcgagacggagtcttgctctgtcacccaggctggagtgcagtggcgcgaactcggctcaccgcaacctccgcctcccgggttcaagcaattctcctgcctcagcctcctgagtagctgggattacagacgcgcaccaccacacccagctaatttttgtatttttagtagagatggggtttcaccatgttggccagggtggtctcgaactcctgtcctcgtgatccgcccgcctaggcctctcaaagtgccaagattacaggtatgagccatttttaggattacatatttttaggatctcactatctgttaaggctattaagttttcctcacatacttcttaaatgaattttccctgttttttactttttctttttaacttttttttttttcttcccgagacagggtctggttctgtcgcccaggctggagtgcaatggcgcaatctcaggtcactgaaacctctgcctcctgggctcaaaccatcgtctcacctctgcctcccaagtagctgggactacaggcctgcaccaccatgcctggctaatttttgtatttttggtagagatggggttttaccatgttgcccaggtaggtctcacactcctgggctcaagtaatcctcccacctcaacctcccaaaaatgtgttaggattacaggcatgagacaccatgaccatgcccagtgtaactcgtcttttaacttagtttatgatagcttttgtcagatgaaatattttttagtagcaaaatccatcaatcttatagtaactttaggaattaaaaagcaaacacctgttttagagttcctggtgcttcatgctcaatttttatttcacttgccttaattttaggatactagcatcaacacaatttgaacccactgcagctagaatggcctttccctgctttgatgaacctgccttcaaagcaagtttctcaatcaaaattagaagagagccaaggcacctagccatctccaatatgccattggtgagtctgcactcctgtgtattttctataggaaaatctactgattctctgtgacttgcactagcccagtgacagtcaacattgggtcacctgttttgttttattgcctggcagatcgttactaacttttcatttataacctatgcttttgtttcaagccatagttatatgtaatcaaagtaaaaattgcacctaaaaatgcaagatttcagtaacagtgccattccaggttatacatgctgataggagggaagtggtataagaaattcaggtcaggtttaaatattagtgcccttcacaaagcactttcaccctcattttctcatatgatcttttaaaatgattttaaaggtaatgctttgtcaataaggccatatttttagcatacagttattttctctaagttacatatactatatagtaatattcattatataatttgtaactgaatgtacaaaattgggcagacagaaaaagagaataaaagtaatcttttccaaatattatggtgctgaaggtaagtcatgatagatagcttagcttccagagggaaactattattccccaatctcaatgcggatgtggacagcattccctctgatttttaaaagtgactagaagatgaccatgccaaatgaataaaactgttcagtaagtgccatcatcctttgattctggtagtttagaaaagcatcagctgggccgtcattctgcagctggtatataacacctcctggaagcacatcctttgttcagagaaactcactggggatcagagtcagagtagaataggctttgcctagagtcctgagggaagaacagctttgtccctgtgctgaccggggaagcaatatcataacatggagagatactgagagccacagaccaacctctagtgtggtgcttctcaaccttaaaactctatacctacctgccttcataccataaggatgccttcctcaaacaagattcggatctcccaccccacgccagagggctatcctctgtaaaaatcactcttctgcaaattcctaccagccaagaacttctgtccccactcccacccttgtatatgaaaagacaagaaacaattatgctattttcctaatataaatttaatatacaggatgtgctttttcaaaatatagtcctctcccccagtattgtggtattactccctgggacagaagtgagttctttaattggtgaatcaaagttctaggagaataaaggaccagggatgggaaggagacaggagagagactgaaggaccaaacaggattagtggagaaatttgtaggctttcagaagggaggcctggagctttggaagcgccacaaagatgctacagtctaaatccatggatatccaggatccacttagtgaagataggaaaacttcttttttttttttgaggataggaaaacttctaatgcaatgttgtccctttggacgggaatacctctcactaacagaaatctaatacgagtagcctgacctcaggctgcagatattgagctgaggggagaacaatggggtctcaaaagatctttttggagaccagaaaaacacaatatataccattggaacattgaagcttttgggcatggggcagaaattaatcacatttaaatttgaattaatttaatcaggttattttcctaataattaacacaactcgagaatggaaatttttggccaggtgtggtggctcatgactgtaatctcggcactttgggaggctgaggcaggtggataacctgaggtcaggagttcaagaccagcctggccaacatggtaaaaccctgtctctacaaaaatacaaaattagctgggcgtggtggcacatgtctgtaatcttagctacttggggggctgaggcaggagagtcgcttgaactctggaggtggaggttgcagtgagtcaagattgtgccattgcactctagcctgggtgacagagtgagactccatctcaaaaaaaaaaaaaaggaaatttttgttgtaggtaggcagaagcagaatgcatttaaaaagaaaagatgatttgggatcctttatgagtaatcctaggctgggtagcagagttggtttgaatgaccaaatagtgaccagaagttggtggctgatgggtattaagaaggatgagggccaggtgaggtggcttatggttgtaatcctaacactttgggaggcagaagaagaggatttcttgaggtcaggagtccaagaccagccagggcaacatagcaagaccctatctctcaaaacaaaaaaaaaagatgaggtcagagcaatagaggtaagtattggattacaggaaaaatgcccgtgaccatggtttcacccagctaattctggctggttctttttccatctccgtgctttttattgctgacgtgttagactttcttctttaggggcagacctctaagactgtacctccatcaactataccccacccttactctctgattgcacttaaaaaggtgattccaatgaagcaaatgaagcaaatctttttttttttttttttttgagatggagtctcgctctgtcatccaggctggagtgcagtggcgtgatctcggctcactgcaagctctgccttccgggttcatgccattctcctgcctcagcctcccgagtagctgggactacaggcacctgccaccacgcccggctaatttttcatatttttagtagagatggggttccaccgtgttagccaggatggtctcaatctccttaccttgtgatccacccgcctcggcctcccaaagtgctgggattacaggtgtgagccactgtgtccggcccaggttactttcagttatacagcagaacagaagctcttttaggtactacagggttatatattttccccgttgcgtatatgctcaacagctcgacattgcattgccagataattctcaaacctgtatttaaggaaaagtggatcagccacatcttggcaaaactcacaatttcagttttgctttgtctcatccgtgttatcaatccacatatgccaaatgtggatttacagtgtattgtaaactttaaaatggtaagttgtatggtatatgaattatatctcaataaaaaagaaattgagtagaactgtttgacgttaatgtctaaattataattagacattggaaagataacttttaaagtaactatagaagcgtcattagacagggtctggctctgtcatccaggcaggagtgcagtggctcaatcttggctcactgcaacctccacctcccaggctcaagccatccttccacctcagcctccccagtagctatgactacaggcacgcaccaccagcaggactaatttttgtattttttttgtagagatagggtttcaccatgttgcttaggctggtcgcaaactcctgagctcaagcattctgcctacctcggactccccaagtgctgggattgatacacttttaatattatgtctgataattaggaaatttatcatgttcactgtattggataattggattacttgataatttgaattattctgattttaggtgaaatctgtgactgttgctgaaggactcatagaagaccattttgatgtcactgtgaagatgagcacctatctggtggccttcatcatttcagattttgagtctgtcagcaagataaccaagagtggagtcaaggtgagcctatgactgtcacatatggtgaccagcttgttctggtttgcttggaactggttttaaaactggaagtctgcctgagcgcagtgggtcgtgcgtgtaaacccaacataaacccaacagtttgggaggctgaggtggaagaatcacttgaggccaggggtttgagaccagcctggacaaaatagtgagaacctgtctctgcaaaaaataaaataaaaaaattagccaggcatggttccttgtgcctgctactagtcctagctactagggaggatcccttgagcccaggagtttgaggcttcaatgaggtatgattgtgcactccagcctgggcaacagagcaaaaccatgtctctaaacaaacaaacaaagacaaaaccaaataccaaaatcctggaagtcctgcatcctgggaaccttctcaatctcaggcaaactgggatggttggccagcctgttgtcacggatgctcatttgtatagtgaggttctaataacaacaacgtggagagagtgtggcctggcctgagtcatgatcctggcttcactgcagtcacttcactgactctctgaccttggccctattccctctgaaacttagtatttacttctttggaaggtataacttggactagatcctgcaatggtctctaaggttgcttctggttatggctttctgcagtttggaagtaaatgttactatctggcaggggatttctggctatggtaaggaagatagagcaacctgcttggaatacccaaaggctttgggccaggtacactggaatgctggagagaaaaatcttgtttcaaggcacacttgttcctcatttgggtactgttgcatagtgggcaacctattcaactgtgtgccgtagctcagaatgcaaacaggtttttctgaggggaggaagggatgctttgtttgaagataccttatgtgtttgtgctggttttcactgaggcctgaatagatggggattccctgctgaattgctttgtgttcctctagtgctgagatttcttattcttgtggaggtatctttacttaactggggatttgaaggtgacgcttgagactcggatgaagggaacattcttaattcagcagtgaaactatcagcaaaaacacccgcccattgctttgccacttatctgaatctcttagaaatgattattttagtaatgtctaatctatattaatatttttaattctttcatttctttaaacacattaagcatacaattatatatctgtgtctggtaattgttttatctgaattctttgtgtatctgattttgtggttcgttgtttctgctggctcttgcttatggtatcttgtttccttgtttgtattatgaattatgtttgtgagcttacgttgcctgagtctaaagtggattattccagagagaaattgtatttgctcttacagagtgtctgggagtacttactggtccagggatcactttacttgtagtttccttgagaaagggtagttatttctagtttacctttacattaaaggcctggcctttgggtactagctttatgcagggattgtatgtcctgttagactttctactttgggcaggccctggacttggtctcttaactcctgagtccttcaatgacataagaaccaaagctcaagtccagctgtgttgggctagtgccggcagggttaaagctggctgcagtgctctcctgacatcagagggtctaactgtcatttcactttggcttctaaatctttctttctcatttgccatcttataaacacatttaagaacactttatacatgttatccagcatttgttgttgttttcagaagggggattaatcaggaacagtcagtattaatgcaagaaatggaattcccaattattttctttaatattggcaaccatatcccacaatatgaagacattaatgtcagtcttctacacaatgtggggagagaagccagttaagatatttgaattcctttctgtgcctttctctttaggtttctgtttatgctgtgccagacaagataaatcaagcagattatgcactggatgctgcggtgactcttctagaattttatgaggattatttcagcataccgtatcccctacccaaacaaggtagagattttgcacagatattacacatgacatttgatgaacacagtcatagatttgtcattataattggcacatccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctttcttacacaagcccttaaaactattgtatgtttgattttttaggtatatgtgggtcttgggcatccaaaatagaatggattattataattgtttagtttttcaatttccaaactcctcatcagaaggttagaaatggagtcaagaggcctgaaaaggcgggcacggtggctcatgtcttgtaatctcagcactttgggaggcccaggcaggtggattacttgagcccaggagtttgaggccagcctgggcaacatggcaaaaccctgtttccacaaaagtacaaaaatattagctgagtgtggaggtgcactcttgtagtcccagctacttgcaaggctgagatgggaggatcacctgagcttgggaggttgaggctgcagtgaggtgtaattataccactgcaaatgcactccagtatgggtgacagagtgggaccttgtttccaaaaaaaaaaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccaggtataagctcattcacacttttaataaagtataaactacatttatattgcttctatgggacatataaggctatttatataatttttactttgtctttttttaataggaaaaattgtttctccaaagcattcgtttttatgtcttataatgcatgttgaactttttttatttttaccttgattaaatattggtcctgtaaatatatgttaacattcataaacttatattggacatctaaaatatacttctttctgagtgtctttgtttatggcttatgttgtgcttttagtggtttgggaacctggtcactatggaatggtggaatgatctttggctaaatgaaggatttgccaaatttatggagtttgtgtctgtcagtgtgacccatcctgaactgaaagttgtaagtagttatttatccttcacatttgaggttaatttgttgttttgttcaatattgctggaaaatattcactaatctttgattatagaacttataaaaatatttcactgataacttccttgacagtttagatatgaatcgtgttgcaaaaatgctagtgaactttcaagatataccacaaagacttatttacaaactcagttgtgaatctatgattgtttgtaaattgtccgattttatatttcttaatatcaaagaaatagaaataatggcagcctaaatgttccatttcattttcccaaccttcaggttgctcattgcagaattattaggtacagattactgatatctcaataggaccctacttgccaaatcaaatgagttatacttaaggtaactgcacatttgattgtataacaacctaggcttctggatcacaaatttattgctttggaactgctatatggtttattttttaaatcaccacatttaacttaagaaaatcacatatagcaaaattaaacttatgtaaaaatttttttatcctactccaatgattcttttcatttgtaaatatttattcctattttcatctgcctgtatacattatttaaaatatacatttgtgaatatttattactgcctattttcatctgcctgtgtacataattagaaagtacacatcaatattgcattataatcctaaatattttcttatgtttctacatgatctttagtaataaaaatgattatggatacatattgtcctgttgagctaatgtgctctaataaagctggttaaggttctccatttattttcattatgtttttaaaggtaagtatctttgctctaaaacagtacagacaatgattggaaatgttgaaattactatacagttaatttcttgttgtgttgctgtttggctataggcataattgtttcgtttttagattaatacgaaattttctttattctaaaggacttaagatgaacaaaatctataatgtttaactaaaatcattgtttcttgggtagcttttagaatatattaattctattttgtttcataaatattaggaaatatggaataggttgcccccaaaatgtgaagtatggacttcttgcctcagataaaatgtcccacctttgacattttttatctaaatgtaaatcataggtgatgttttcttttttctatctcaatagggagattatttctttggcaaatgttttgacgcaatggaggtagatgctttaaattcctcacaccctgtgtctacacctgtggaaaatcctgctcagatccgggagatgtttgatgatgtttcttatgataaggtaaaagtagattgagtataaggatacagtttagatactaaagttatacatactggggtggagaagttataggcaaggttgtggggttaaacccagattgaatgccttctctcttgacacgtgctggctggagtcaactcttttaggactaacttgcagtttggctcataaccctaaagattattttatgggaaattcttcatatattctttcttgggttgaaaattcatggcttacagaaactctgcttttattcatcattcaacaaataggtattgattgagcatcaactttgtactagacaaaaattcctgccctcgtgtagcttacttttcaaggccttcagcaatggttaatattgttgagacgcaaataattgtcttgcacagtgtgcttagtaacagagttgggaattgttgacaacagtttaatgattgggagattttatgtaaaatccagatttctagcttctcttggggaagaaaaaggaggatttggccactgtatgttctttgcagcataagctggagctaagttgttgttctctctttgtaagatcaaggctctgcttttccactttccctgccattcccaactgttctattgtcttctcaccgaggctgagagtgtgttgccagttaccattgtgcttggctgttgttttaccggtagcaaacagaaaagtctttcttgcttgcatgtttccattgaaagtccaggggaaaaagaatgtaaaagagcattcttcttatccttggactacttcccttatttatatgccctgtcatgtgccactggaggcatttgagtttgtgactcaccatccgtggtaatgggagtggaggggaaaagagccctttaccaaggaatacagggtgtctgggaagactcttgttccctttctcattgtgactccagctccatcagccctccatgctcaaggctgcctgggctccctggacatatccacttttccttccctggcatctacctctgcctccatctctagtgctccaccccttgttgtactggcctctccttagtcctgccctggaatggcagtgggagagccaggtagtagctcaaggtccaatgtttaatctgcaccattatccccactcacatgtgaacaaagggagttggcagatgatgctaatttgccccatcgggaggtctggctactgatagaaaataagggcctcagtgggctcagagcataagcaatcacattagacaaatctcctgcctaaacaggtccaggtttaacctgcttactctgtttcacaaattgccagacattaacagtgttcctgcagttgcgttttcaaagaaatgtgttttattgcaaaagaatatgtgatttcagatgagactgcaatgaaactatagataacaattatttctattatcttttcagggagcttgtattctgaatatgctaagggagtatcttagtgctgacgcatttaaaagtggtattgtacagtatctccagaagcatagctataaaaatacaaaaaacgaggacctgtgggatagtatggcaagtgtgagtatgtttttgaatatctctgcatttgggattgacaggcttatcatcttgttttgttttccctgcattatgttaatccctctgaggagaatcattgttttctatagaaataagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttcccttttaaagcagtggatttatgacatgtttctatagcagattacagctgcattgtagcagtcaaaaggatatgtcagtcatttacagagctctgcatttgtacaaagacaatggcactgagcattcttgaatacttgtcatgtgtcaggcacatgttaagcacttatatgtattatctcctttactcttcataataaacctgtgagctgggtactattactatccctatttttaaagttgagaacatgaaatacaaagacatctgattggtaaattgcagagcagagatctgaatttagatctaactcatgtttttaactgctaagctataaagtattcataacatcaagtcacaaaacagcctgagtctctgttcatctggacttgtgggatgttttcagaggaagctgagggtgagtctggagatacaacagaattttttgtttcttttttctttttatatgtttactttcttggcttttttgttcctagagactgctttattcagtagtttctagatttgtcctgtggcacattttatctttttactaattcttttttttttgagacagagtctcactctgttgcccaggctggagtgcagtggcgtgatctcggctcactgtagcctctgcctccccggttccagcgattctcttgcctcagcctcccaggtagccgggattacaggcacacgccactacacccggttaatttttgtattcttagtagagatgaggtttcaccatgttcgccaggctggtcttgaactcctgacctcaggtgatccacccaactcagactccgaaagtgctaggattacaggcatgagccaccgcgcccagcctttactacttcttaaatcatttcttaaaagcttttttagtatcaaaaaacagctccttttgagttcccactatttgttgagtgtgggtcatctctgtgttctcactttagaaacacaggctcttgactgaacattgtttccaccttgcttgtccaaaaccagcatagttaggtaggtattgaaaacctggcactttctctcccttctcttccttcattcattcacatgcctgctttgtgcccagtgttattgccagccccaaagtgtgcccggcagaactaggtatgctacctgtcctccagacacgtatgtgtagtggaggaaaatgacaagcaaacagctggtgctctaatggaggtgtgatggctggggacatcacactgagaaagggatcagaaagtgctcctaagaggggaggttggcaactggtagcggctgtttgagcataagctggtgttctctcttttcttagagttgggttaaatgggtgatgtgtctgcctttttgtgtacacaccagcattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtaatgctcctagagtaaaatttgttttgttgtctaggtaacatctgccttgtaggatggaaccttgcttttgaaataatgcccttaccactattgctaaaatatttcagctgcatctgtgtatcctatgaagttgacttatactccctgcccccatcttcccagtaggattaaggaggctttaaaccttggttattctcagtaaaggtgacgatgtaattactttaacattctcatattttgtaatttgatatgatggtaatttctggttactggcttgaaatcaactccaacctaagcaactgctactagattacaatagtgcctagcatttggttggagctgaggacaaaagaatttaggtgatttccgagaatgatgagagactcagttgtcttcttctgagttagatttggaacctgtttgtcagcttaatgctatagaagaatattattagaaacaagatgctgcaacttgattgaccctggatggataccgttaaaaaattcttttatcttgaaacaatttcagacttatagagaagttacaagaataacacaacaaattcctatatatcctttacctagatacatgttaactctttactcctttactttcttcacctccctctctctcttgctctctctctctctctatatatatatgtatatgtttgtgtggatatatgtgtgtgtgtatatatacatatatatgtgtatatatatacacacacatatatatatataatatatacacctccctcccccatcttcccaaaaggattaaggaggttttaaatcttgattaatcgatatccatctatctacatacatacctatatacatatgtctgtatgtatatacttggcatatgtttttctgaactgtttgacagtaaattggtgacatgattccccttcacacctaaatgtttcagcatagtattttctacaaaacaacatttatggccggtcacagtggctcatgcctttaataccaggactttgggaagccgaggcaggaggatcacctgaggttaggagttcgagaccagcctggccaacatggtgaaacaccatctctactaaaaatacaaaaattagccgggcatggtggcgggcgcctgtagtcccagctactcaggagggtgaggcaggagaatcgcttgtacccaggaggtggaggttgcagtgagccgagatcgcaccactgcactccagcctggacaacaagagcgaaactccatctcaaaacaaacaaacaaaaaacaagaacattcagttatataaccatagccacagtacaattatcaaaattgggaaataaactttatataatactattatctataaatcccattcaactttttccaattgtcctaaaaatatccttatagcaaaatagaaaataaattctgacttaggatttaatacaggatcacttattttatttagttgttgcatcattttggtctccatttttttctgaaacaactcttcagtcttttttgggcttctcgatattgacattttttgaagagtactggccagttattttatagaatgcctttcagtttggattttctgctgtttctccatgatcaggttcagcttacatatcattgacaggaatcccaaggaggtgatattgtgtccttcctaatatactattcaggaggcacatgagtcctgaagttaggcctctgagatgcaatcagccaatcactgtaaaaaggctttcagggttcacgtgagtccaaattcttagctctactcaaggagtccaagaaaaggaaatagtgcccgagctgacactccctacaaagctggaaaacagactggggatgttttgagagcttggctgtagcagttttggtactatcttgttctaaactaaccagtgcctggcacatgataggtgatttaataactgcttgttgaattgaatcaacaaatgaacaatccacctctcctttattttaggtacctgtggcatgttccattgacattcatcaccagcaaatccgacatggtccatcgatttttgctaaaaacaaaaacaggtaatttattttggaaactactagttaattcaaggaggaatgtgaaaatgtgtaggattaaagtgctgtttcttttgctatttatcttggttaaagcaaaagggatcagattgaaaatgctttctggtttcaaagaagaatggccaatatcttgccagatagagattatagctgaattatataatgctaaaaaggagggattaccagtgaacattcactattactttgttaacattactgggttatatcatatgtatggccagagatgtagttgccattcttttcatagatctgtaaatctcacaaaattgatgtctaaagctagtgttagcttttgtctattgagttgctgttttctggtttctgagagaaataagtgatgttttcaaatttttcagtattaaactcttctctaatttccttgcccaatcttggatgagaaaagctttcttcaggcaggggagcaaatggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcaggtaatacacgctgcacaaagtcgcggtttatttctgaaagcagctgttattgttcaaattcttgatttctaaagacaaaaatgattgattgataacaagaagttgaaaggtgttttcctttaagttcttctaacaacccaagattgcttttagtcttataattaacctcctgtctgtgactactaaggcacttgaaggaaggaatctgtatcttaatctttctcattaataattcagatcatactgaggcggaagtgtagataaccaggagatcaacatcctggcgaaactccttgccttgtccccgcggcatggtcccgcagcttcttctggccccgctataccggatcaggtttctcccaccactgggtctttataacagccttgaagtcttcttagaagactaagtgacacaggcccaagttgtttgcattacatttcttgggttaaagaagggatttttttttctttcctaaaccagatacctgaactttgcagcatctttatggaatatagctcataaaatgtagcccaaccaaatgatctctgagtgtgtgaagacagaattaacactaccctttttttttcctcccccatgacaatggtttttaaggaaatgctcccaaagcctaaaactcaaacttcttcaacatgtaggcagacctaaagtcctaagaggaagcatgcaggtgggaaggattatctctttctcctcatacccgtatccttctggcctaaattttgagtgccttctggttcttctcaccaccatactgggcctcctgaagtgagaaaaagcaatgggggagaaagttatgggttgcttacctagctgtttctttctgcctaaaaaattcccctctgtagaatatttctgcttgagccttagagggcttcttcttttttattttttaacttatataatatataccctaccactgaggtttttaacactaaccctctgtaatgaagggtttctaaggatatgcagtgtctttgaaatggagaagaaaatgtgtttcctccaggaactcatggttttgaccagatgatagtctgtttgaccaggcttcctaaagggtctttgatggaaatcccttgcttactctagaagttcaccactcaatccagtgtttcacagggatagatgctgatgtgcttcctttccggcttatccacgttagccctagacgttactgtttgagaaacttcctccctagtgtaaacatgccggatgttgtgttatatgtgatagaaaagagacttatatagtagttatctatctgtttgtttatttattttttggagatggagtctcactctgtcgcccaggctggagtgcagtggtgccatctcagctcaccgcctctgcctcccgggttcaagtgattctccggcctcagcctcccacataccaagtacctgccaccatgcctgcctattttatgtatttttagtagagacggggtttcaccatgttggccaggctggtcttgaactcccgacctcaggtgatccacctgccttggcctcctaaagtgctgggattacaggcatgagccaccgcgcccggccgtagttatctatttataagggacatttatatctgattgcttgttttgctagaagattaaaatatattttgaagcaaaaagttgacttcccggatttacttttaaaccactaaccacagtgtctcttggtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggtaaaagcctgaaataaaagttatgtaattattatttgtgttaaaaagtgttaatcattgtgtgtgtatgtgtgtgtgtgtgtgtgtgtgtgtgtgtgtgtgtgtatctttatatacatattaaggaaaagcaaataaatattagttcagtatttagatggactagcaagattttggttttatttggcactaaaaataggaatggcattcttagactctatttaatttgcatggatttgttatttccttcctttcacaaaccttttatttcattttcctttcctattacaatggctgacgttcagattttctgggactcttcatggtacttgaggaagaggcacaaaattgttatgcttggcaaaatgtcctgaagtcttgttgcataatttgctctcaaaatttagtcatgtaaactctctttgagtttgttttaaaagtcgcaattcatcctgactttaagtagatggatatcttataaaagtttgttatgaaaatatgaaagtcattcatcattatttattgtttttggcccttttataattaaacagtgctgcatgatttatacagtaaaagttagattatgctttaaaaattagcccccatcatctgagaccataatggattatattaacatgaaatgacctgtgacaatactggtccctgtttccctgtacaacgccctcaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgaggtcagtccttactaaataaccaatttgttgatgtgaagggcatcttttctgttttccatcattggtactaaacattagggaaaacaaaaagtttaagtgtctcccctgctgcccttttctggaaaataaattgctttttaagatttatctatgtatctcgtaactttaagaaatgctaggagggaacttctatgcataaaagtcaaatatctggggagttaggatggtatgggaataattctcattttgtataggcaatgcaaaatcttattaaacggtgacagccatgccatagagaaacacatgcattgtattttatagtagtttctttgggcttccaaattccctgacagggatgcatagtaattgctgacactgtctaagcaaggtaggattttaccgtatctggaaatccctattcttgctacacttcagtcctttttacatttggagcttaaaccccacccaggaaacatttatgccaacaacctacatgcttcagcttaaagaaatccaaacagtggtcctactgccgtcctgacttgtgatcatggtgtaaattttgaatatagtttgaatttcttttggcttgaaaggtgatcccctatggagtcacccagcatcattaaagtatttaaatatgtaggtatttataaaaatggcatttcacatttttgagaaggctacttaaaacctaattttagatatttttctcttgccttttttttataaagtgtaactaggccaggcgcggtggctcacgcctgtaatcccagcactttgggaggctgaggtgggtggatcacgaggtcaggggatcaagaccatcctggctaagacggtgaaaccccgtctctactaaaatacaaaaaatgagccgggcatggtggcgggcgcctgtagtcccagctactcgggaggctgaggtaggagaatggcgtgaacccgggagggcggagcttgcaggaaccgatatcgagccacggcactccagcctgggtgacagagcaagactccgtcctaaaaaaaaaaaaaaaaaaaattgtaactgaaggaaatcagtagtttttgtttatatttccaggcatgcttctctgatcatggggaaagttcagcagttcatagttagtcaccattatgcctctaaacatacttactgcacctcagattctcaccgagtgtgttcctttctatagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggtgagtccgtcattcattcatgttcatgtggccaagggaaattagattagattagatcattctggcatctatttttgttttcttggccaggaattgcctatcctgctgggaacatactgcaagtcagcacacatctaatgagaaaggcaaataattagggagaaccaggtgttaggaaaaatatttaaaggtgtatacatttgtgcatctttaaaatgacaacatattaaaaatatttactagagctactcttccttaactattcttttgagcaaatgagagggtatatgagaatgggtgttatgaacactatataaatgttagtttttattatgtagctatagtgggtttatcaggattgtggttacccatttatctttttaacctttgttactggcagacttttttttcttttacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaaaaaaaaatctatatatatatttttaaacataaatgaaaattagctaattaatatggggtagacaaaatactttgagggtgtggtgagttagaaatggattgtcatttagaagttatttttggatgctatggtgttgacagcagcataaatcagttgcaattaaactagtgaaaactgtgcctcttctcagacacgttaagaggtcttagctctgccagtaaaaaccttaggacttgaagaaaattacttgagacaattagtccttgtttaaggatgttaaaagtgggcactgaggtataaatgactgaagtggtcatccagctgttgctaaagaggcaggtccggaatctaggttctttataaaccatccaagttcatggttccctgtcacttattatgtaaccatctaccttcagaaagaatttcaggcagctttaagatccatgtataaaagaaatgttaaaatgaaggacaaaaagatacataatggacaggtgataaccatgtgagggacttatggctgaggataattctcgcaattgtcccctgaatttatcacagacattcctggaagtcaaggaaaaatgaggaatcagtatgagttattctcattgtctggtaaaagagaacatgaagcatacacattttctacaaaagcagacttttcttcagtcctaaactcgaggactttgatgtgtgggccattgagttctgtggtgtcccttctataataaggtttcctatagtaaagttgtggaacaaattttacaaggctcttaaactgtggtacatttagataaaagctgagaggctaatattaatttttttaggagtggttccattgtgtagtctggttacactattttctagcttgagatggggagagagctttggaaatgaaaaagaatgaagggttgttacagtctcgtagcttttttccagttttcagtagcctcatccaggcttgtaaaattaacttgcatataataattcaagcttgaactccagcgaggtctagagcagagatactctgtctgatgactgaagagatgtccaaagccttgaccagaaaggtagtcatctatagacaagatctatagcaacaaagcatttcattcattcacttgtattctcattaattcattcaagacatatatgccacacatggttttaggttatggggctgtaacagtgaacagacagacaaaacctttgctgtcacggagctgaaatttctgctgtgggaatcagacaattacagacaaatcaaccaatgtcaagtagttacatgctctgaagatgaataaggcaaggagagtgattgggatagagggttggtgctgttttataggatgattaggagacatttgagaagatatcgaaggaaatgccaacatctagaggagtattgtgtgcagaggaaatatcaggtgcgaagatcctgaagcagggcatgaaaagtaaagagcccgagatgttatcataatggagagcaaactacggacatataaaatacgggagtcatcctgaatcctttcttccccagacatctaactacgcaagtcctgccggtcttccctcagcacatgcactggatcttgcgcacttctctctgctcttacccccattcaatcctttctcatctcttgccttgcctattgcaatagtgtcctaactggcctcccccttgccactttgccaatagcaaaacattttccacattgaagactgcaagtcagcccataactgaccctggcttcttgaaaccctgcctattgttcttgcagtaaattccaaatccctccttcccatgtgtccatgaccttgaagacctggcttctgaggacctctctggtgccaattcccacaggcgctcctggcttactctctcataacactgtagccactcagcctccttctgctcctgggctaccacatgtttctcctgtctttaagcctctgcactttttattctctctgcctggcttgcccattccccaacttttcactagaaaggggcattttatctttgagaggtctcggctcagatcaccttccccaaaaccatgctgttcaatgcaggccacatctcctcagttactagcatacccctggcatattttcttcatagcagtttatttacagtaatcatatttactgcttgtataccccaaaagactgtaagctccatgaggggaggatgcttgcctgattcactgctgcatcctcagtgtctagcacagtaattacagcagagggatgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaactttatgtggattttatcttgagacaacaatacatgaattgtagattaggataaaaaaaatggcaaggtttgggtcttaccgccataacttgctaagaatcccattccccacagtgtttctataataacatacaaggccaggcccatggagaaagacagcacttacgtggtggaaactgttttgcttggcaaagaaaagactctgcacattctgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgaagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttccataaagccagacgctatacagtgcaaaggctaatgtggcaatagctctaaagacacagttgctgctcaggttttatgtatagataatagaaagcacagtttactaacacagtaaaccaacagagttcaagtcagatgagtaccctaagaattaattagattttatttcttatgctcgaaatttgctacacaaggacttatctaacctttattttgctctgttgctgacttgattcaagtctcagtgtgttctgtgctgactgtaagatgcagaagtcctcacacctggcaaagaagagttcaaactgaaaaggggtttggtgcttcctggtttgtccaggttacctgttattaatttattattagcagcccaagaggagatatgtgcccaatgtacaatatcttatgtttgacttataaacattatcccaaagcaacatcaaatacagttcaaaagcccaagaggaaagggggtaataagaaatcagaacactgaagaatgtttaaaacattgttttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccagctgaagattttacatgcagataccttaaaaatttcaaataaaaaatgcagtgaatcatttaatatgtaattttcttgttacagacatagtaaatataccacttagcaaaagcattgtataacagacagaaggaatttcctataagtaaacatgaaagtggattaatagaattttttttaattttgggaaaaatgttagagcagttctacctaatatagctccttttttcctaggaaataaacatggatcatggtgagagagctgaacccgatttaacctatactttgatttcttttaggctttggtcagtaagtgcttgtatgcttttaaggcttacattaagccctctcctttctgaagattaagataagggcccagttctgaagatctcagaaatcccttcaatctgtccagtttcttcagcaattataaattagaatcaaacacagtactttactttccaaaataatgacaaataaaaatggccaatcttttcctttgcccttgttcccaaaaccctgtaatttccaccagactctaaagggtacttctccccaccccaccatgtattggtattctggggaatgccaatgtcttcaggacatttcgctaagttgtaacatgctaattttgctttgccacaataacctgcagtaatgagcatttggatttcaaagattcaactagcctcagatggtcattctaagtgcctggcctaatatttttaaaagcttttaattataagattaaggtttttaaacatttcaatagcaaactcatcccatttagtgctttcagagaatgaccaattactctgtagatcttgcagtatgcatttcatgccaatactgtaaagtgagcatgaattactcaagaggtggacttcacttctctcatctataacacataaattggcagaagatacagttgtcttcatttacaaataaacacccaacttaccagataccttaacttgtatttctttagtcatcttttggcttggaagtttcctctgttgtctaaaagggaaagcaaaaccatccgtgagctttcttttctgtattaagtatgaggagatggccttctcagaattaggggacaaaagatggcagtcagtggggaaaaataagatggtcctttcagtttctcttcttcatctggccacaatattgtgagttcttcctcctcaagcttataagctaaaaataaccttaagtgatcctgatcctaaatgtatcactctcagctttatttttttaaggctagggtaggttataaaatatgcataggtgttcttaaatggcaatgtttcattctgtggtgatccttcctttcctgtacatagggtcatggctgtccagtaaatccactcatcataaagggttattatgctttctattatttgttaaagggctgattaagtacttcgtataactgaaattaaataataggcaaataagtatttaaactgagatataatggcataactgccaattatcaatgctgtttcctatatcccttaagggaatctactacaggaagattttaatatattgttttaaaagctttggtgtaactggactattgtctttaaagctacacctttaactcctccttatagccaggggatcatagtaataatcatttaaatcatatgttcttggaattggaagggacctagaagttgtctaatccaattttcatttctcatcacagcttgagtaattttaataataggaagtttccaacttccatgttctaaaatctatataaaccacatactatggtggtattttaattagggcaagaaagacaggcaaaacacaggcaaattgggttgtgtcaagaacattcatttaggattttaaagcaccagttacttaaaaatatatgtatttatacaaattcaattactttaccaagcgatgctatgggatagatagtactttaagaaattttattctaaatagattccagtaggaaactaaatgactgaaatgataaaccctactctgtgtaactgctaaactaatttgtagtatatttactgctccatttacctttgctgaatccttcgctttacctccattcttaggtgctttggagctggaagcagccttcttgcacttatcctaaagcaaaggaaatgtaatgaggctatggctatcaccaatccatctagcaattaactaggctgcagttaaattaatccagaccattctgagatctccaatttaattaaataatggaagactttgggtgttttttcatgattttttttgaacaacggtgtcagagaattgtttaaagcaggagggaaaaaggatagaaataaggagggaaatgtgggtgacattgatgctctaattcccgtggtgcctgactcacccagaccttattttgctaatcaaaacagagcttgtcaatagataataaatgtcggcaagggtgtggagaaaagggaaccctagtacactgtcagtggggatgtagattggtatgggctatgatggaaaacagtatataggttcctaaagaaattaaaagtagaactactgtatgacccagtaatccctcttctgggtatatacccaaaggagatgaaattatcaccttataaagatatctgcactcccatattcactgcaacattactcacaatagccaagatatggaacaacctagttgttgatgaatggataaagaaaatgtcatgtatatatacataatggaatattattcagccttaaaaaacgatatcctactatttgtcacaacatggatggacctggaagaccttatactagatgatataagccagacacagaaagaaaagtgatttcacttatatgtagaatatatataaaagaaaaagctcaaaaacacagagaataaaacatggcgaccatggtagggaacaggaggaggaaacagagatataggtcaaaggatacaaaatagcagatatgcagaatgaacaagtgtagagagttaatgtataacatgaggactaaggttaataaaattgtattagggattttgttaactaagtagattttagctgcttttgtcacaaaaagtagttgtgtgagaatgatagatatgtaaatctgcttccctacagtaaccattttattatttctatgcatcccaaactaccatgttgtaaacctcaaatatacacaataaaatgtatttaaaaaacaaaatagagcttgtctcgatcaggactggcttttgtgtaccaaaaggcaaaaaaaaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatagaaaaaaaaggaaatccacaaaataatactgttttgggggcagtggaattataggcattttttcttttcttcattttcaggttctctatatcatcgtttgattcattctacagtttaaaaattgtaagggccaggcgcagtggctcaagcctgtaatcccagtactttgggaggtagaggttggcagatcacttgagcccaagagctcgagaccagcctggcaacatggcgaaaccccctctctacaaaaaaatacaaaaattagctgggtgtggtggtgcacgcctgtagtcccagctactcaggaagctaaggtaggaggattgcttgagcccaggaagcagagatcgcagtaagctgagatcacaccactgcactccagcctgggctatagagtaagaccctgttacaagacagaccgatagatagatcaatcaataaataaaacttatatgtatgtacacatacacacacacacatttcaaagagtgaaatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtggaattgctatcttgaggaatactgaatgcaagcaaggagaattggttcctgtaataggagaccctgaagctgacactgctatttaaaccaggaatcatcttactcaccaaaatgaatcagtacagaaagagaagggtgtaatttggtcttccttgtttcttatttgatgaacaggcatggaaagggttatttatcatctaattgactcaaaaattagaaactaaataggaaagaggtgggggacaggcctggttgacctacgaaagactggcctctatcatgtgggagacaaaaggccagggactttttggcagagaaacaggatttgtgattgggaatattgctttgcctgtcttcacttgcaatagtgctgatgatgatgcaggagaagatagggagaccccaggtcttggagctgccttattaattttccctattaattatcccaacaccagctccttttctgctctccttaaacagagattgcttcctttgaaatcctatcaccttagtcatttttatagccttttcttgaaagagagaatcacatttcttggatcactcttaagcatctgtgagtgactgaacagtattcaaccctgtttataccacagagcctagcatatgcatatataatgatattggctcaaataaatatttacctgctggtcggctttggtgacacattagaagcagtcagtcatggtatgttttatgctattgtaaaggagtatagctactatttatttcaagggaggtttgaatttaaagatcttggtagcataaatccgatctagcaatttgcctcagtttacctgtccattatcatccaggagatgtctgtattcaggtgggatagtgtcatctctttctccaagcttgtctctatgttcagctttagctttttcctatatcaacagtgagcagatagaattaatattcatttcctctttcacttagaaaatacattgtcaaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggaaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctccgctggtatctctgtcacagattcagtgaccttcccctccagtggagtacagattgatttttctatttcattataatttcatgtttaaaatataggttaagttcacatcaatattcctatgacaatgacagagtcaagacccaaggattaaaatttcactattagtgaattttttttttttttttttttttttttacctttactttatcttccattggtttgttctcatctgggtcaggctgcctttgtcctagactgtcagagagtttatccaaggcatcatcgaggtctttgtcactctgctgaaaagtaaataatgctgaattagtcactcattagccaaactgtatcagaggcaaattagcccaggaactccatcttttcaggagggaacctgtttccttggaagaaaaagacatctggggctggggcaggggagtagacagggtcagagaagagaagcctaggaatggaagatcaggagaagagcggcagtatctgtcaccctactggggttggagggccagcaccttccacccaaccctgcccatctcttggtgaagatcccaccaggttaaggaggtcttagtggcagcctcaggagccatatccagtgggtgacctggaggtcacataaagggtccaaaagcaaatgaaccaatcatgtgtgcctttcatttagaaattaaacaccattagaaaactggatatgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggacaacaatatcactgtaactaagatagcttatttcctctaacatttatttactgtatgattcaggcagcttatttaacccctttcagcttcagtttccttggccgtgaaatgtgaataatagtagtacttatactcctaagttgctgagaaaagtaaatgattgaaaaggcatttaaaacaatactagttgtatgttaggacccaacaaatggtaaattattattagtattattatagcaaaatccatatttttcaacacattgcattcaaaattccacctctaaatgaattcaattaaaatgtgtttaatatctacattgtataagacaccatgctgaactctgtccaatactgtatagaactttccagttgattttcaaaatgttttcacatacactatccagttttatttgatgcccacaatggttctcagtgaactaagcaggctttttttttttgaggtaaaaagctcagggaagctaagtcagttgcttgaaaacaaattgttaaaaagtgaatagaacccaggtcttgggactgataaagcttttccctgtcatgcttagtcacatccatgatcttctattttctttgaagcagttttcctgttggagtgattttattacacagatctttgaaatcatgtcttcaaatgctttcagtgtatgtaacactgttagtaacaatctaataatcacagcaaagaaagctcccgtgaattatcatggtttatttgactcttcgatttcctaatatttttatctaaataaagctttataccttgttttagtgacatcttcaaataaaatgttaactaaaaacaagcctctctgatgggaaatgtgatcagagaagtgtcattgtaaaacctacttcttaaaggcaaaaaagtttttgattgcaaatgtttactgatagccttcatcagggcagaatctctggcctgaatattaagaactgaagtgtaaacggcagcctaggctattaatgattcttcctttctgttgcatggggactttcttcattgtgggtgtgtttacatacacacatgcacatgcacatgcacatacacacacacggggcattttactggttttaagtgctttattataatccaggattatagctgctaatggtagagctgcccggggccaggtctgggctttgtcatttgtgcctctggatattttcagatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 3 - DNA, 47291 bp, Homo sapiens
  source 1..47291: mol_type = genomic DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctggtggggtgggatgcgcgggccgtgtgtgttcttaaggtcacttccctccctgcttctcctgttcttctggtcagcaattctctctctccccttcgctctggctctggctgggttttattcagataaagcacctctgttgacgcaaattaaaagtttcctatctgggtgcctcactggccaggtggtcctacaaagttaattccatgaggggaagggggagagcacacacttcctcacgcttttggatttctttgtgtaggctaggttcagaaagaaattatctgtttcctattaaacacccagaggattcgctctgaactcaggacgtggtcaacaattaacaaaacaacaaaacaaaacaaaacaaaacaaaaaacttgaaaattgggcacagttgtctcttgcctgaggatttttaattagtataagtagcacattttcaggtgcggcctgaatagaaacattctagtacttttttttttttcaaattaatccagcatttttattatttaccaacagtgcttgttaatttcattgttcaggaaattctggaagaacctcaattacttcttgatgatctatttcatatactatagtgccccaataaaaggaagggaggcagaggttgcagtgagccaagatcgcaccactgcactccagcctgggagacagagcgagactccgtctcaaaaaaaaaaaaaaaaaaaaaaaagagggatcttggtgaagctgaaaaagcagggagtttatactcacacagatgtggattgcattccaacaagttgtgtgaacttagcaaagttacatgaatggttctttgcttcagttaccccaccttgaatgagaataataggctattagagagagtgagcatgtgtaaagtgcctggcactttggaggagcttagtaaatattagttctttttcctccttggcttctattcctttaagtgttagtggagtgtaacttcaaagagaattgtacttctcttgggaagagctgcttatattgagtagactactgtttttgagagctttctttttttttaactgcctccctttcagaaaattgttagtaaaaccagaccctaggagaccagccagaaccatgaaatgccatgtttcaaactggaacacttactattggaagcaaagccaaacaagagctaatttttcaggggaagagccaaacacacgaacatgatcacagaatcttggatgtagcctacagtttgggattaataagagaatttattagtgaagccctttattcactacatggagtttttaccaagccccactcatgcactgcatcctcgttgagacataactgtttctctttggacccctcatggacccaaccctgcaaagcctctgatccaaggtcccggtaccaaccccttccgcagcacatcagcctttctgtcagctcataacgagttggaatttctagatcttctctggggctgttggagaggtctcggggactttcagagtccttacatgcttgaacctgccaccttcacagagtcctctggatcccgtcttggggcaggggcgatgctcattaagctgttgctgccagtaattccatatggaaagcaaaacacaagttccatttactctctagttccccaacttcaagggcaaaaaaatgttctccctgttcacacttcctgtctcacctgggtggtgccttttgaactgggattatgagatttccaagactctctctaatgtgtaggtatcctttctgtttagcctccagattgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagttttttttttttttaaaaaaaaaaaccaaaaaccagaaattaaacaatccgtaaaaccataccccgatcttatcaccataggttccagtttaattgttgtcaataaggacccaggcatcgaaaattttaaaagcttcccaggttacattaatatgcagccagagttaggaaacttgacatctcagagagggagaattccatgtactgtgaacactttgagggatccacattgtaagcttgctacttttcccaactggaacacgaggagtttgggccaatcacttgcattcacctggtatgggcccctcttggcaaacacccattagaaaggtgcgtttgtataaaagaaataaaaacttatgtttgatgcttggggcatggtttgccaacttccttaaaattcacattgccttttttttttttttttaaagacagagtcttgctctgttgccaggctggagtgcagtggtgcaatctcagctcactgcaactctgcctcccaggttcaagcgattctcctgcctcagcctcccaagtaattaggactacaggtgcgcaccaccacacccagctaatttttgtatttttagtagagacgggatttcgccatgttggccaggatggtctcaatctgttgaccttgtgatctgcccacctcatcctcccaaagtgctgggattacaggcgtgagccaccatgcctggcctgaaattcacattgcttttatgtctttaaaatcaatccaggtgattgatacgtttgccacaaactactgggaaaattaagctctttaagctcttcctggctaaataaataggtaattaacttttggcatgacaatttgaggaagacactgatgttattaaaggttaccattacatatacttacaggggaagtggagacctcgttctagtggtggctgccactgtgtcagcatttgatttccagggtactagggtgactttctccaaggtccagtgtcagtggggagtggtgcttgatcagatgttcctctgatatggttctggttttgcttctttcatgagcctggtttcccaaatgtcctgcaactctgtgacccgtgtagtgagccactcaggatcccctaatgattccttttctgcctatatcagccagagcttgttcggttgctttcaaccaagaaccctgacaggtagagttaatttaaactttgaacatcaaatgatgctttctagtacgtgttaatgattgttgctaactgtaaacatctttcttatatgaaaccataacatagggaaggtccttttactttcaggaaaagacctagtacttttggaagtttatgcctatttctgtgaatgctgggtggatacattctgaaattatgctgtgtcaataacattttaatgacatatatttttgcttttgtacatttgtgccgctaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtatttttttttctctttttcttttaaactgcaagtgctgcccacgctaaattcattatttcagattgattgtcttttaaaattccctttgctgttgaactttttcttcagttttgcttttgcatcttctttatagtgttaaaaatggctttttcccttgctttttaaatctcattttaaaattctattttaaccaattttctttcccccagctctatcagagtaaatatctatttgtttatttggttcgatttctgagacataataaacatgtttaattttcctgaactgtgtattagtttcctagggctgttgtaacaaagtaccacagactgggtagctataaacaacaaaatgtattctctctcaggtctggaggctagaagtctgaaatcaaggtgtcagcaggcccgtgctccctccagactctgggtagaatccttccttatatcttcctagcatctagtggtggccgtggatccctggtactccatgcctagcacctgcgtcattctagtttctccctctgttagtcgcatggccattctattttcctatgtcccagtctccatcttcttataaggaaaccagacataccagattagggcccagcctggtggcctcttcttcactccatgatacttgtaaagaccctatgtccaaataaggtcacatgcacagatactacaggttaggacttcagcaaatcctactagcaacatattagaggaaatacttttatctcagttaaaacttttttagagatctcttctcaccttgctttggttctgtttttaaggaggagacttatttgggggagattttatgctcagttttaaaatggaattttatttgttggtagattatactaatttatttttcaaattccatattattttatcaaggtaagaaagtaaaatttatttcactcatagccccctgaactgaccactacttctatttcactggaatattctgccagacttctttctggatatgcatatatattattttatataaatagaattcttatattttctcttttacaaggaaattttttaacttaatatgttgggaagatgttttatataaatgactattactagacatctttttaatgattttattaaaatacatagttgtacattaatatctttaatccctcgggaatggaaatgaaattgtttccaatttttcagtatcaacaacactttgatgagcatttttgtaaattatttctttagaataaatgcctagaagtaaaattggtaagccaaagagcctataaatttttgataaactttgtcattttttcttacccctcaccaatagtgtatattggcagtctttttagagcaaaaaaggtccccaaataaatgatctctttttaatttacgtaactttgattaaggaagttgagcagcttttgatatgtttgttaatgatttataggttcttcttttatgaattgcctgttaatgacctttgactttgcctgagattcccttggttgttggggattttttttttttttttttttttttttttgtcgagacggagtcttgctctgtcacccaggctggagtgcagtggcgcgaactcggctcaccgcaacctccgcctcccgggttcaagcaattctcctgcctcagcctcctgagtagctgggattacagacgcgcaccaccacacccagctaatttttgtatttttagtagagatggggtttcaccatgttggccagggtggtctcgaactcctgtcctcgtgatccgcccgcctaggcctctcaaagtgccaagattacaggtatgagccatttttaggattacatatttttaggatctcactatctgttaaggctattaagttttcctcacatacttcttaaatgaattttccctgttttttactttttctttttaacttttttttttttcttcccgagacagggtctggttctgtcgcccaggctggagtgcaatggcgcaatctcaggtcactgaaacctctgcctcctgggctcaaaccatcgtctcacctctgcctcccaagtagctgggactacaggcctgcaccaccatgcctggctaatttttgtatttttggtagagatggggttttaccatgttgcccaggtaggtctcacactcctgggctcaagtaatcctcccacctcaacctcccaaaaatgtgttaggattacaggcatgagacaccatgaccatgcccagtgtaactcgtcttttaacttagtttatgatagcttttgtcagatgaaatattttttagtagcaaaatccatcaatcttatagtaactttaggaattaaaaagcaaacacctgttttagagttcctggtgcttcatgctcaatttttatttcacttgccttaattttaggatactagcatcaacacaatttgaacccactgcagctagaatggcctttccctgctttgatgaacctgccttcaaagcaagtttctcaatcaaaattagaagagagccaaggcacctagccatctccaatatgccattggtgagtctgcactcctgtgtattttctataggaaaatctactgattctctgtgacttgcactagcccagtgacagtcaacattgggtcacctgttttgttttattgcctggcagatcgttactaacttttcatttataacctatgcttttgtttcaagccatagttatatgtaatcaaagtaaaaattgcacctaaaaatgcaagatttcagtaacagtgccattccaggttatacatgctgataggagggaagtggtataagaaattcaggtcaggtttaaatattagtgcccttcacaaagcactttcaccctcattttctcatatgatcttttaaaatgattttaaaggtaatgctttgtcaataaggccatatttttagcatacagttattttctctaagttacatatactatatagtaatattcattatataatttgtaactgaatgtacaaaattgggcagacagaaaaagagaataaaagtaatcttttccaaatattatggtgctgaaggtaagtcatgatagatagcttagcttccagagggaaactattattccccaatctcaatgcggatgtggacagcattccctctgatttttaaaagtgactagaagatgaccatgccaaatgaataaaactgttcagtaagtgccatcatcctttgattctggtagtttagaaaagcatcagctgggccgtcattctgcagctggtatataacacctcctggaagcacatcctttgttcagagaaactcactggggatcagagtcagagtagaataggctttgcctagagtcctgagggaagaacagctttgtccctgtgctgaccggggaagcaatatcataacatggagagatactgagagccacagaccaacctctagtgtggtgcttctcaaccttaaaactctatacctacctgccttcataccataaggatgccttcctcaaacaagattcggatctcccaccccacgccagagggctatcctctgtaaaaatcactcttctgcaaattcctaccagccaagaacttctgtccccactcccacccttgtatatgaaaagacaagaaacaattatgctattttcctaatataaatttaatatacaggatgtgctttttcaaaatatagtcctctcccccagtattgtggtattactccctgggacagaagtgagttctttaattggtgaatcaaagttctaggagaataaaggaccagggatgggaaggagacaggagagagactgaaggaccaaacaggattagtggagaaatttgtaggctttcagaagggaggcctggagctttggaagcgccacaaagatgctacagtctaaatccatggatatccaggatccacttagtgaagataggaaaacttcttttttttttttgaggataggaaaacttctaatgcaatgttgtccctttggacgggaatacctctcactaacagaaatctaatacgagtagcctgacctcaggctgcagatattgagctgaggggagaacaatggggtctcaaaagatctttttggagaccagaaaaacacaatatataccattggaacattgaagcttttgggcatggggcagaaattaatcacatttaaatttgaattaatttaatcaggttattttcctaataattaacacaactcgagaatggaaatttttggccaggtgtggtggctcatgactgtaatctcggcactttgggaggctgaggcaggtggataacctgaggtcaggagttcaagaccagcctggccaacatggtaaaaccctgtctctacaaaaatacaaaattagctgggcgtggtggcacatgtctgtaatcttagctacttggggggctgaggcaggagagtcgcttgaactctggaggtggaggttgcagtgagtcaagattgtgccattgcactctagcctgggtgacagagtgagactccatctcaaaaaaaaaaaaaaggaaatttttgttgtaggtaggcagaagcagaatgcatttaaaaagaaaagatgatttgggatcctttatgagtaatcctaggctgggtagcagagttggtttgaatgaccaaatagtgaccagaagttggtggctgatgggtattaagaaggatgagggccaggtgaggtggcttatggttgtaatcctaacactttgggaggcagaagaagaggatttcttgaggtcaggagtccaagaccagccagggcaacatagcaagaccctatctctcaaaacaaaaaaaaaagatgaggtcagagcaatagaggtaagtattggattacaggaaaaatgcccgtgaccatggtttcacccagctaattctggctggttctttttccatctccgtgctttttattgctgacgtgttagactttcttctttaggggcagacctctaagactgtacctccatcaactataccccacccttactctctgattgcacttaaaaaggtgattccaatgaagcaaatgaagcaaatctttttttttttttttttttgagatggagtctcgctctgtcatccaggctggagtgcagtggcgtgatctcggctcactgcaagctctgccttccgggttcatgccattctcctgcctcagcctcccgagtagctgggactacaggcacctgccaccacgcccggctaatttttcatatttttagtagagatggggttccaccgtgttagccaggatggtctcaatctccttaccttgtgatccacccgcctcggcctcccaaagtgctgggattacaggtgtgagccactgtgtccggcccaggttactttcagttatacagcagaacagaagctcttttaggtactacagggttatatattttccccgttgcgtatatgctcaacagctcgacattgcattgccagataattctcaaacctgtatttaaggaaaagtggatcagccacatcttggcaaaactcacaatttcagttttgctttgtctcatccgtgttatcaatccacatatgccaaatgtggatttacagtgtattgtaaactttaaaatggtaagttgtatggtatatgaattatatctcaataaaaaagaaattgagtagaactgtttgacgttaatgtctaaattataattagacattggaaagataacttttaaagtaactatagaagcgtcattagacagggtctggctctgtcatccaggcaggagtgcagtggctcaatcttggctcactgcaacctccacctcccaggctcaagccatccttccacctcagcctccccagtagctatgactacaggcacgcaccaccagcaggactaatttttgtattttttttgtagagatagggtttcaccatgttgcttaggctggtcgcaaactcctgagctcaagcattctgcctacctcggactccccaagtgctgggattgatacacttttaatattatgtctgataattaggaaatttatcatgttcactgtattggataattggattacttgataatttgaattattctgattttaggtgaaatctgtgactgttgctgaaggactcatagaagaccattttgatgtcactgtgaagatgagcacctatctggtggccttcatcatttcagattttgagtctgtcagcaagataaccaagagtggagtcaaggtgagcctatgactgtcacatatggtgaccagcttgttctggtttgcttggaactggttttaaaactggaagtctgcctgagcgcagtgggtcgtgcgtgtaaacccaacataaacccaacagtttgggaggctgaggtggaagaatcacttgaggccaggggtttgagaccagcctggacaaaatagtgagaacctgtctctgcaaaaaataaaataaaaaaattagccaggcatggttccttgtgcctgctactagtcctagctactagggaggatcccttgagcccaggagtttgaggcttcaatgaggtatgattgtgcactccagcctgggcaacagagcaaaaccatgtctctaaacaaacaaacaaagacaaaaccaaataccaaaatcctggaagtcctgcatcctgggaaccttctcaatctcaggcaaactgggatggttggccagcctgttgtcacggatgctcatttgtatagtgaggttctaataacaacaacgtggagagagtgtggcctggcctgagtcatgatcctggcttcactgcagtcacttcactgactctctgaccttggccctattccctctgaaacttagtatttacttctttggaaggtataacttggactagatcctgcaatggtctctaaggttgcttctggttatggctttctgcagtttggaagtaaatgttactatctggcaggggatttctggctatggtaaggaagatagagcaacctgcttggaatacccaaaggctttgggccaggtacactggaatgctggagagaaaaatcttgtttcaaggcacacttgttcctcatttgggtactgttgcatagtgggcaacctattcaactgtgtgccgtagctcagaatgcaaacaggtttttctgaggggaggaagggatgctttgtttgaagataccttatgtgtttgtgctggttttcactgaggcctgaatagatggggattccctgctgaattgctttgtgttcctctagtgctgagatttcttattcttgtggaggtatctttacttaactggggatttgaaggtgacgcttgagactcggatgaagggaacattcttaattcagcagtgaaactatcagcaaaaacacccgcccattgctttgccacttatctgaatctcttagaaatgattattttagtaatgtctaatctatattaatatttttaattctttcatttctttaaacacattaagcatacaattatatatctgtgtctggtaattgttttatctgaattctttgtgtatctgattttgtggttcgttgtttctgctggctcttgcttatggtatcttgtttccttgtttgtattatgaattatgtttgtgagcttacgttgcctgagtctaaagtggattattccagagagaaattgtatttgctcttacagagtgtctgggagtacttactggtccagggatcactttacttgtagtttccttgagaaagggtagttatttctagtttacctttacattaaaggcctggcctttgggtactagctttatgcagggattgtatgtcctgttagactttctactttgggcaggccctggacttggtctcttaactcctgagtccttcaatgacataagaaccaaagctcaagtccagctgtgttgggctagtgccggcagggttaaagctggctgcagtgctctcctgacatcagagggtctaactgtcatttcactttggcttctaaatctttctttctcatttgccatcttataaacacatttaagaacactttatacatgttatccagcatttgttgttgttttcagaagggggattaatcaggaacagtcagtattaatgcaagaaatggaattcccaattattttctttaatattggcaaccatatcccacaatatgaagacattaatgtcagtcttctacacaatgtggggagagaagccagttaagatatttgaattcctttctgtgcctttctctttaggtttctgtttatgctgtgccagacaagataaatcaagcagattatgcactggatgctgcggtgactcttctagaattttatgaggattatttcagcataccgtatcccctacccaaacaaggtagagattttgcacagatattacacatgacatttgatgaacacagtcatagatttgtcattataattggcacatccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctttcttacacaagcccttaaaactattgtatgtttgattttttaggtatatgtgggtcttgggcatccaaaatagaatggattattataattgtttagtttttcaatttccaaactcctcatcagaaggttagaaatggagtcaagaggcctgaaaaggcgggcacggtggctcatgtcttgtaatctcagcactttgggaggcccaggcaggtggattacttgagcccaggagtttgaggccagcctgggcaacatggcaaaaccctgtttccacaaaagtacaaaaatattagctgagtgtggaggtgcactcttgtagtcccagctacttgcaaggctgagatgggaggatcacctgagcttgggaggttgaggctgcagtgaggtgtaattataccactgcaaatgcactccagtatgggtgacagagtgggaccttgtttccaaaaaaaaaaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccaggtataagctcattcacacttttaataaagtataaactacatttatattgcttctatgggacatataaggctatttatataatttttactttgtctttttttaataggaaaaattgtttctccaaagcattcgtttttatgtcttataatgcatgttgaactttttttatttttaccttgattaaatattggtcctgtaaatatatgttaacattcataaacttatattggacatctaaaatatacttctttctgagtgtctttgtttatggcttatgttgtgcttttagtggtttgggaacctggtcactatggaatggtggaatgatctttggctaaatgaaggatttgccaaatttatggagtttgtgtctgtcagtgtgacccatcctgaactgaaagttgtaagtagttatttatccttcacatttgaggttaatttgttgttttgttcaatattgctggaaaatattcactaatctttgattatagaacttataaaaatatttcactgataacttccttgacagtttagatatgaatcgtgttgcaaaaatgctagtgaactttcaagatataccacaaagacttatttacaaactcagttgtgaatctatgattgtttgtaaattgtccgattttatatttcttaatatcaaagaaatagaaataatggcagcctaaatgttccatttcattttcccaaccttcaggttgctcattgcagaattattaggtacagattactgatatctcaataggaccctacttgccaaatcaaatgagttatacttaaggtaactgcacatttgattgtataacaacctaggcttctggatcacaaatttattgctttggaactgctatatggtttattttttaaatcaccacatttaacttaagaaaatcacatatagcaaaattaaacttatgtaaaaatttttttatcctactccaatgattcttttcatttgtaaatatttattcctattttcatctgcctgtatacattatttaaaatatacatttgtgaatatttattactgcctattttcatctgcctgtgtacataattagaaagtacacatcaatattgcattataatcctaaatattttcttatgtttctacatgatctttagtaataaaaatgattatggatacatattgtcctgttgagctaatgtgctctaataaagctggttaaggttctccatttattttcattatgtttttaaaggtaagtatctttgctctaaaacagtacagacaatgattggaaatgttgaaattactatacagttaatttcttgttgtgttgctgtttggctataggcataattgtttcgtttttagattaatacgaaattttctttattctaaaggacttaagatgaacaaaatctataatgtttaactaaaatcattgtttcttgggtagcttttagaatatattaattctattttgtttcataaatattaggaaatatggaataggttgcccccaaaatgtgaagtatggacttcttgcctcagataaaatgtcccacctttgacattttttatctaaatgtaaatcataggtgatgttttcttttttctatctcaatagggagattatttctttggcaaatgttttgacgcaatggaggtagatgctttaaattcctcacaccctgtgtctacacctgtggaaaatcctgctcagatccgggagatgtttgatgatgtttcttatgataaggtaaaagtagattgagtataaggatacagtttagatactaaagttatacatactggggtggagaagttataggcaaggttgtggggttaaacccagattgaatgccttctctcttgacacgtgctggctggagtcaactcttttaggactaacttgcagtttggctcataaccctaaagattattttatgggaaattcttcatatattctttcttgggttgaaaattcatggcttacagaaactctgcttttattcatcattcaacaaataggtattgattgagcatcaactttgtactagacaaaaattcctgccctcgtgtagcttacttttcaaggccttcagcaatggttaatattgttgagacgcaaataattgtcttgcacagtgtgcttagtaacagagttgggaattgttgacaacagtttaatgattgggagattttatgtaaaatccagatttctagcttctcttggggaagaaaaaggaggatttggccactgtatgttctttgcagcataagctggagctaagttgttgttctctctttgtaagatcaaggctctgcttttccactttccctgccattcccaactgttctattgtcttctcaccgaggctgagagtgtgttgccagttaccattgtgcttggctgttgttttaccggtagcaaacagaaaagtctttcttgcttgcatgtttccattgaaagtccaggggaaaaagaatgtaaaagagcattcttcttatccttggactacttcccttatttatatgccctgtcatgtgccactggaggcatttgagtttgtgactcaccatccgtggtaatgggagtggaggggaaaagagccctttaccaaggaatacagggtgtctgggaagactcttgttccctttctcattgtgactccagctccatcagccctccatgctcaaggctgcctgggctccctggacatatccacttttccttccctggcatctacctctgcctccatctctagtgctccaccccttgttgtactggcctctccttagtcctgccctggaatggcagtgggagagccaggtagtagctcaaggtccaatgtttaatctgcaccattatccccactcacatgtgaacaaagggagttggcagatgatgctaatttgccccatcgggaggtctggctactgatagaaaataagggcctcagtgggctcagagcataagcaatcacattagacaaatctcctgcctaaacaggtccaggtttaacctgcttactctgtttcacaaattgccagacattaacagtgttcctgcagttgcgttttcaaagaaatgtgttttattgcaaaagaatatgtgatttcagatgagactgcaatgaaactatagataacaattatttctattatcttttcagggagcttgtattctgaatatgctaagggagtatcttagtgctgacgcatttaaaagtggtattgtacagtatctccagaagcatagctataaaaatacaaaaaacgaggacctgtgggatagtatggcaagtgtgagtatgtttttgaatatctctgcatttgggattgacaggcttatcatcttgttttgttttccctgcattatgttaatccctctgaggagaatcattgttttctatagaaataagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttcccttttaaagcagtggatttatgacatgtttctatagcagattacagctgcattgtagcagtcaaaaggatatgtcagtcatttacagagctctgcatttgtacaaagacaatggcactgagcattcttgaatacttgtcatgtgtcaggcacatgttaagcacttatatgtattatctcctttactcttcataataaacctgtgagctgggtactattactatccctatttttaaagttgagaacatgaaatacaaagacatctgattggtaaattgcagagcagagatctgaatttagatctaactcatgtttttaactgctaagctataaagtattcataacatcaagtcacaaaacagcctgagtctctgttcatctggacttgtgggatgttttcagaggaagctgagggtgagtctggagatacaacagaattttttgtttcttttttctttttatatgtttactttcttggcttttttgttcctagagactgctttattcagtagtttctagatttgtcctgtggcacattttatctttttactaattcttttttttttgagacagagtctcactctgttgcccaggctggagtgcagtggcgtgatctcggctcactgtagcctctgcctccccggttccagcgattctcttgcctcagcctcccaggtagccgggattacaggcacacgccactacacccggttaatttttgtattcttagtagagatgaggtttcaccatgttcgccaggctggtcttgaactcctgacctcaggtgatccacccaactcagactccgaaagtgctaggattacaggcatgagccaccgcgcccagcctttactacttcttaaatcatttcttaaaagcttttttagtatcaaaaaacagctccttttgagttcccactatttgttgagtgtgggtcatctctgtgttctcactttagaaacacaggctcttgactgaacattgtttccaccttgcttgtccaaaaccagcatagttaggtaggtattgaaaacctggcactttctctcccttctcttccttcattcattcacatgcctgctttgtgcccagtgttattgccagccccaaagtgtgcccggcagaactaggtatgctacctgtcctccagacacgtatgtgtagtggaggaaaatgacaagcaaacagctggtgctctaatggaggtgtgatggctggggacatcacactgagaaagggatcagaaagtgctcctaagaggggaggttggcaactggtagcggctgtttgagcataagctggtgttctctcttttcttagagttgggttaaatgggtgatgtgtctgcctttttgtgtacacaccagcattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtaatgctcctagagtaaaatttgttttgttgtctaggtaacatctgccttgtaggatggaaccttgcttttgaaataatgcccttaccactattgctaaaatatttcagctgcatctgtgtatcctatgaagttgacttatactccctgcccccatcttcccagtaggattaaggaggctttaaaccttggttattctcagtaaaggtgacgatgtaattactttaacattctcatattttgtaatttgatatgatggtaatttctggttactggcttgaaatcaactccaacctaagcaactgctactagattacaatagtgcctagcatttggttggagctgaggacaaaagaatttaggtgatttccgagaatgatgagagactcagttgtcttcttctgagttagatttggaacctgtttgtcagcttaatgctatagaagaatattattagaaacaagatgctgcaacttgattgaccctggatggataccgttaaaaaattcttttatcttgaaacaatttcagacttatagagaagttacaagaataacacaacaaattcctatatatcctttacctagatacatgttaactctttactcctttactttcttcacctccctctctctcttgctctctctctctctctatatatatatgtatatgtttgtgtggatatatgtgtgtgtgtatatatacatatatatgtgtatatatatacacacacatatatatatataatatatacacctccctcccccatcttcccaaaaggattaaggaggttttaaatcttgattaatcgatatccatctatctacatacatacctatatacatatgtctgtatgtatatacttggcatatgtttttctgaactgtttgacagtaaattggtgacatgattccccttcacacctaaatgtttcagcatagtattttctacaaaacaacatttatggccggtcacagtggctcatgcctttaataccaggactttgggaagccgaggcaggaggatcacctgaggttaggagttcgagaccagcctggccaacatggtgaaacaccatctctactaaaaatacaaaaattagccgggcatggtggcgggcgcctgtagtcccagctactcaggagggtgaggcaggagaatcgcttgtacccaggaggtggaggttgcagtgagccgagatcgcaccactgcactccagcctggacaacaagagcgaaactccatctcaaaacaaacaaacaaaaaacaagaacattcagttatataaccatagccacagtacaattatcaaaattgggaaataaactttatataatactattatctataaatcccattcaactttttccaattgtcctaaaaatatccttatagcaaaatagaaaataaattctgacttaggatttaatacaggatcacttattttatttagttgttgcatcattttggtctccatttttttctgaaacaactcttcagtcttttttgggcttctcgatattgacattttttgaagagtactggccagttattttatagaatgcctttcagtttggattttctgctgtttctccatgatcaggttcagcttacatatcattgacaggaatcccaaggaggtgatattgtgtccttcctaatatactattcaggaggcacatgagtcctgaagttaggcctctgagatgcaatcagccaatcactgtaaaaaggctttcagggttcacgtgagtccaaattcttagctctactcaaggagtccaagaaaaggaaatagtgcccgagctgacactccctacaaagctggaaaacagactggggatgttttgagagcttggctgtagcagttttggtactatcttgttctaaactaaccagtgcctggcacatgataggtgatttaataactgcttgttgaattgaatcaacaaatgaacaatccacctctcctttattttaggtacctgtggcatgttccattgacattcatcaccagcaaatccaacatggtccatcgatttttgctaaaaacaaaaacaggtaatttattttggaaactactagttaattcaaggaggaatgtgaaaatgtgtaggattaaagtgctgtttcttttgctatttatcttggttaaagcaaaagggatcagattgaaaatgctttctggtttcaaagaagaatggccaatatcttgccagatagagattatagctgaattatataatgctaaaaaggagggattaccagtgaacattcactattactttgttaacattactgggttatatcatatgtatggccagagatgtagttgccattcttttcatagatctgtaaatctcacaaaattgatgtctaaagctagtgttagcttttgtctattgagttgctgttttctggtttctgagagaaataagtgatgttttcaaatttttcagtattaaactcttctctaatttccttgcccaatcttggatgagaaaagctttcttcaggcaggggagcaaatggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcaggtaatacacgctgcacaaagtcgcggtttatttctgaaagcagctgttattgttcaaattcttgatttctaaagacaaaaatgattgattgataacaagaagttgaaaggtgttttcctttaagttcttctaacaacccaagattgcttttagtcttataattaacctcctgtctgtgactactaaggcacttgaaggaaggaatctgtatcttaatctttctcattaataattcagatcatactgaggcggaagtgtagataaccaggagatcaacatcctggcgaaactccttgccttgtccccgcggcatggtcccgcagcttcttctggccccgctataccggatcaggtttctcccaccactgggtctttataacagccttgaagtcttcttagaagactaagtgacacaggcccaagttgtttgcattacatttcttgggttaaagaagggatttttttttctttcctaaaccagatacctgaactttgcagcatctttatggaatatagctcataaaatgtagcccaaccaaatgatctctgagtgtgtgaagacagaattaacactaccctttttttttcctcccccatgacaatggtttttaaggaaatgctcccaaagcctaaaactcaaacttcttcaacatgtaggcagacctaaagtcctaagaggaagcatgcaggtgggaaggattatctctttctcctcatacccgtatccttctggcctaaattttgagtgccttctggttcttctcaccaccatactgggcctcctgaagtgagaaaaagcaatgggggagaaagttatgggttgcttacctagctgtttctttctgcctaaaaaattcccctctgtagaatatttctgcttgagccttagagggcttcttcttttttattttttaacttatataatatataccctaccactgaggtttttaacactaaccctctgtaatgaagggtttctaaggatatgcagtgtctttgaaatggagaagaaaatgtgtttcctccaggaactcatggttttgaccagatgatagtctgtttgaccaggcttcctaaagggtctttgatggaaatcccttgcttactctagaagttcaccactcaatccagtgtttcacagggatagatgctgatgtgcttcctttccggcttatccacgttagccctagacgttactgtttgagaaacttcctccctagtgtaaacatgccggatgttgtgttatatgtgatagaaaagagacttatatagtagttatctatctgtttgtttatttattttttggagatggagtctcactctgtcgcccaggctggagtgcagtggtgccatctcagctcaccgcctctgcctcccgggttcaagtgattctccggcctcagcctcccacataccaagtacctgccaccatgcctgcctattttatgtatttttagtagagacggggtttcaccatgttggccaggctggtcttgaactcccgacctcaggtgatccacctgccttggcctcctaaagtgctgggattacaggcatgagccaccgcgcccggccgtagttatctatttataagggacatttatatctgattgcttgttttgctagaagattaaaatatattttgaagcaaaaagttgacttcccggatttacttttaaaccactaaccacagtgtctcttggtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggtaaaagcctgaaataaaagttatgtaattattatttgtgttaaaaagtgttaatcattgtgtgtgtatgtgtgtgtgtgtgtgtgtgtgtgtgtgtgtgtgtgtatctttatatacatattaaggaaaagcaaataaatattagttcagtatttagatggactagcaagattttggttttatttggcactaaaaataggaatggcattcttagactctatttaatttgcatggatttgttatttccttcctttcacaaaccttttatttcattttcctttcctattacaatggctgacgttcagattttctgggactcttcatggtacttgaggaagaggcacaaaattgttatgcttggcaaaatgtcctgaagtcttgttgcataatttgctctcaaaatttagtcatgtaaactctctttgagtttgttttaaaagtcgcaattcatcctgactttaagtagatggatatcttataaaagtttgttatgaaaatatgaaagtcattcatcattatttattgtttttggcccttttataattaaacagtgctgcatgatttatacagtaaaagttagattatgctttaaaaattagcccccatcatctgagaccataatggattatattaacatgaaatgacctgtgacaatactggtccctgtttccctgtacaacgccctcaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgaggtcagtccttactaaataaccaatttgttgatgtgaagggcatcttttctgttttccatcattggtactaaacattagggaaaacaaaaagtttaagtgtctcccctgctgcccttttctggaaaataaattgctttttaagatttatctatgtatctcgtaactttaagaaatgctaggagggaacttctatgcataaaagtcaaatatctggggagttaggatggtatgggaataattctcattttgtataggcaatgcaaaatcttattaaacggtgacagccatgccatagagaaacacatgcattgtattttatagtagtttctttgggcttccaaattccctgacagggatgcatagtaattgctgacactgtctaagcaaggtaggattttaccgtatctggaaatccctattcttgctacacttcagtcctttttacatttggagcttaaaccccacccaggaaacatttatgccaacaacctacatgcttcagcttaaagaaatccaaacagtggtcctactgccgtcctgacttgtgatcatggtgtaaattttgaatatagtttgaatttcttttggcttgaaaggtgatcccctatggagtcacccagcatcattaaagtatttaaatatgtaggtatttataaaaatggcatttcacatttttgagaaggctacttaaaacctaattttagatatttttctcttgccttttttttataaagtgtaactaggccaggcgcggtggctcacgcctgtaatcccagcactttgggaggctgaggtgggtggatcacgaggtcaggggatcaagaccatcctggctaagacggtgaaaccccgtctctactaaaatacaaaaaatgagccgggcatggtggcgggcgcctgtagtcccagctactcgggaggctgaggtaggagaatggcgtgaacccgggagggcggagcttgcaggaaccgatatcgagccacggcactccagcctgggtgacagagcaagactccgtcctaaaaaaaaaaaaaaaaaaaattgtaactgaaggaaatcagtagtttttgtttatatttccaggcatgcttctctgatcatggggaaagttcagcagttcatagttagtcaccattatgcctctaaacatacttactgcacctcagattctcaccgagtgtgttcctttctatagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggtgagtccgtcattcattcatgttcatgtggccaagggaaattagattagattagatcattctggcatctatttttgttttcttggccaggaattgcctatcctgctgggaacatactgcaagtcagcacacatctaatgagaaaggcaaataattagggagaaccaggtgttaggaaaaatatttaaaggtgtatacatttgtgcatctttaaaatgacaacatattaaaaatatttactagagctactcttccttaactattcttttgagcaaatgagagggtatatgagaatgggtgttatgaacactatataaatgttagtttttattatgtagctatagtgggtttatcaggattgtggttacccatttatctttttaacctttgttactggcagacttttttttcttttacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaaaaaaaaatctatatatatatttttaaacataaatgaaaattagctaattaatatggggtagacaaaatactttgagggtgtggtgagttagaaatggattgtcatttagaagttatttttggatgctatggtgttgacagcagcataaatcagttgcaattaaactagtgaaaactgtgcctcttctcagacacgttaagaggtcttagctctgccagtaaaaaccttaggacttgaagaaaattacttgagacaattagtccttgtttaaggatgttaaaagtgggcactgaggtataaatgactgaagtggtcatccagctgttgctaaagaggcaggtccggaatctaggttctttataaaccatccaagttcatggttccctgtcacttattatgtaaccatctaccttcagaaagaatttcaggcagctttaagatccatgtataaaagaaatgttaaaatgaaggacaaaaagatacataatggacaggtgataaccatgtgagggacttatggctgaggataattctcgcaattgtcccctgaatttatcacagacattcctggaagtcaaggaaaaatgaggaatcagtatgagttattctcattgtctggtaaaagagaacatgaagcatacacattttctacaaaagcagacttttcttcagtcctaaactcgaggactttgatgtgtgggccattgagttctgtggtgtcccttctataataaggtttcctatagtaaagttgtggaacaaattttacaaggctcttaaactgtggtacatttagataaaagctgagaggctaatattaatttttttaggagtggttccattgtgtagtctggttacactattttctagcttgagatggggagagagctttggaaatgaaaaagaatgaagggttgttacagtctcgtagcttttttccagttttcagtagcctcatccaggcttgtaaaattaacttgcatataataattcaagcttgaactccagcgaggtctagagcagagatactctgtctgatgactgaagagatgtccaaagccttgaccagaaaggtagtcatctatagacaagatctatagcaacaaagcatttcattcattcacttgtattctcattaattcattcaagacatatatgccacacatggttttaggttatggggctgtaacagtgaacagacagacaaaacctttgctgtcacggagctgaaatttctgctgtgggaatcagacaattacagacaaatcaaccaatgtcaagtagttacatgctctgaagatgaataaggcaaggagagtgattgggatagagggttggtgctgttttataggatgattaggagacatttgagaagatatcgaaggaaatgccaacatctagaggagtattgtgtgcagaggaaatatcaggtgcgaagatcctgaagcagggcatgaaaagtaaagagcccgagatgttatcataatggagagcaaactacggacatataaaatacgggagtcatcctgaatcctttcttccccagacatctaactacgcaagtcctgccggtcttccctcagcacatgcactggatcttgcgcacttctctctgctcttacccccattcaatcctttctcatctcttgccttgcctattgcaatagtgtcctaactggcctcccccttgccactttgccaatagcaaaacattttccacattgaagactgcaagtcagcccataactgaccctggcttcttgaaaccctgcctattgttcttgcagtaaattccaaatccctccttcccatgtgtccatgaccttgaagacctggcttctgaggacctctctggtgccaattcccacaggcgctcctggcttactctctcataacactgtagccactcagcctccttctgctcctgggctaccacatgtttctcctgtctttaagcctctgcactttttattctctctgcctggcttgcccattccccaacttttcactagaaaggggcattttatctttgagaggtctcggctcagatcaccttccccaaaaccatgctgttcaatgcaggccacatctcctcagttactagcatacccctggcatattttcttcatagcagtttatttacagtaatcatatttactgcttgtataccccaaaagactgtaagctccatgaggggaggatgcttgcctgattcactgctgcatcctcagtgtctagcacagtaattacagcagagggatgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaactttatgtggattttatcttgagacaacaatacatgaattgtagattaggataaaaaaaatggcaaggtttgggtcttaccgccataacttgctaagaatcccattccccacagtgtttctataataacatacaaggccaggcccatggagaaagacagcacttacgtggtggaaactgttttgcttggcaaagaaaagactctgcacattctgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgaagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttccataaagccagacgctatacagtgcaaaggctaatgtggcaatagctctaaagacacagttgctgctcaggttttatgtatagataatagaaagcacagtttactaacacagtaaaccaacagagttcaagtcagatgagtaccctaagaattaattagattttatttcttatgctcgaaatttgctacacaaggacttatctaacctttattttgctctgttgctgacttgattcaagtctcagtgtgttctgtgctgactgtaagatgcagaagtcctcacacctggcaaagaagagttcaaactgaaaaggggtttggtgcttcctggtttgtccaggttacctgttattaatttattattagcagcccaagaggagatatgtgcccaatgtacaatatcttatgtttgacttataaacattatcccaaagcaacatcaaatacagttcaaaagcccaagaggaaagggggtaataagaaatcagaacactgaagaatgtttaaaacattgttttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccagctgaagattttacatgcagataccttaaaaatttcaaataaaaaatgcagtgaatcatttaatatgtaattttcttgttacagacatagtaaatataccacttagcaaaagcattgtataacagacagaaggaatttcctataagtaaacatgaaagtggattaatagaattttttttaattttgggaaaaatgttagagcagttctacctaatatagctccttttttcctaggaaataaacatggatcatggtgagagagctgaacccgatttaacctatactttgatttcttttaggctttggtcagtaagtgcttgtatgcttttaaggcttacattaagccctctcctttctgaagattaagataagggcccagttctgaagatctcagaaatcccttcaatctgtccagtttcttcagcaattataaattagaatcaaacacagtactttactttccaaaataatgacaaataaaaatggccaatcttttcctttgcccttgttcccaaaaccctgtaatttccaccagactctaaagggtacttctccccaccccaccatgtattggtattctggggaatgccaatgtcttcaggacatttcgctaagttgtaacatgctaattttgctttgccacaataacctgcagtaatgagcatttggatttcaaagattcaactagcctcagatggtcattctaagtgcctggcctaatatttttaaaagcttttaattataagattaaggtttttaaacatttcaatagcaaactcatcccatttagtgctttcagagaatgaccaattactctgtagatcttgcagtatgcatttcatgccaatactgtaaagtgagcatgaattactcaagaggtggacttcacttctctcatctataacacataaattggcagaagatacagttgtcttcatttacaaataaacacccaacttaccagataccttaacttgtatttctttagtcatcttttggcttggaagtttcctctgttgtctaaaagggaaagcaaaaccatccgtgagctttcttttctgtattaagtatgaggagatggccttctcagaattaggggacaaaagatggcagtcagtggggaaaaataagatggtcctttcagtttctcttcttcatctggccacaatattgtgagttcttcctcctcaagcttataagctaaaaataaccttaagtgatcctgatcctaaatgtatcactctcagctttatttttttaaggctagggtaggttataaaatatgcataggtgttcttaaatggcaatgtttcattctgtggtgatccttcctttcctgtacatagggtcatggctgtccagtaaatccactcatcataaagggttattatgctttctattatttgttaaagggctgattaagtacttcgtataactgaaattaaataataggcaaataagtatttaaactgagatataatggcataactgccaattatcaatgctgtttcctatatcccttaagggaatctactacaggaagattttaatatattgttttaaaagctttggtgtaactggactattgtctttaaagctacacctttaactcctccttatagccaggggatcatagtaataatcatttaaatcatatgttcttggaattggaagggacctagaagttgtctaatccaattttcatttctcatcacagcttgagtaattttaataataggaagtttccaacttccatgttctaaaatctatataaaccacatactatggtggtattttaattagggcaagaaagacaggcaaaacacaggcaaattgggttgtgtcaagaacattcatttaggattttaaagcaccagttacttaaaaatatatgtatttatacaaattcaattactttaccaagcgatgctatgggatagatagtactttaagaaattttattctaaatagattccagtaggaaactaaatgactgaaatgataaaccctactctgtgtaactgctaaactaatttgtagtatatttactgctccatttacctttgctgaatccttcgctttacctccattcttaggtgctttggagctggaagcagccttcttgcacttatcctaaagcaaaggaaatgtaatgaggctatggctatcaccaatccatctagcaattaactaggctgcagttaaattaatccagaccattctgagatctccaatttaattaaataatggaagactttgggtgttttttcatgattttttttgaacaacggtgtcagagaattgtttaaagcaggagggaaaaaggatagaaataaggagggaaatgtgggtgacattgatgctctaattcccgtggtgcctgactcacccagaccttattttgctaatcaaaacagagcttgtcaatagataataaatgtcggcaagggtgtggagaaaagggaaccctagtacactgtcagtggggatgtagattggtatgggctatgatggaaaacagtatataggttcctaaagaaattaaaagtagaactactgtatgacccagtaatccctcttctgggtatatacccaaaggagatgaaattatcaccttataaagatatctgcactcccatattcactgcaacattactcacaatagccaagatatggaacaacctagttgttgatgaatggataaagaaaatgtcatgtatatatacataatggaatattattcagccttaaaaaacgatatcctactatttgtcacaacatggatggacctggaagaccttatactagatgatataagccagacacagaaagaaaagtgatttcacttatatgtagaatatatataaaagaaaaagctcaaaaacacagagaataaaacatggcgaccatggtagggaacaggaggaggaaacagagatataggtcaaaggatacaaaatagcagatatgcagaatgaacaagtgtagagagttaatgtataacatgaggactaaggttaataaaattgtattagggattttgttaactaagtagattttagctgcttttgtcacaaaaagtagttgtgtgagaatgatagatatgtaaatctgcttccctacagtaaccattttattatttctatgcatcccaaactaccatgttgtaaacctcaaatatacacaataaaatgtatttaaaaaacaaaatagagcttgtctcgatcaggactggcttttgtgtaccaaaaggcaaaaaaaaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatagaaaaaaaaggaaatccacaaaataatactgttttgggggcagtggaattataggcattttttcttttcttcattttcaggttctctatatcatcgtttgattcattctacagtttaaaaattgtaagggccaggcgcagtggctcaagcctgtaatcccagtactttgggaggtagaggttggcagatcacttgagcccaagagctcgagaccagcctggcaacatggcgaaaccccctctctacaaaaaaatacaaaaattagctgggtgtggtggtgcacgcctgtagtcccagctactcaggaagctaaggtaggaggattgcttgagcccaggaagcagagatcgcagtaagctgagatcacaccactgcactccagcctgggctatagagtaagaccctgttacaagacagaccgatagatagatcaatcaataaataaaacttatatgtatgtacacatacacacacacacatttcaaagagtgaaatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtggaattgctatcttgaggaatactgaatgcaagcaaggagaattggttcctgtaataggagaccctgaagctgacactgctatttaaaccaggaatcatcttactcaccaaaatgaatcagtacagaaagagaagggtgtaatttggtcttccttgtttcttatttgatgaacaggcatggaaagggttatttatcatctaattgactcaaaaattagaaactaaataggaaagaggtgggggacaggcctggttgacctacgaaagactggcctctatcatgtgggagacaaaaggccagggactttttggcagagaaacaggatttgtgattgggaatattgctttgcctgtcttcacttgcaatagtgctgatgatgatgcaggagaagatagggagaccccaggtcttggagctgccttattaattttccctattaattatcccaacaccagctccttttctgctctccttaaacagagattgcttcctttgaaatcctatcaccttagtcatttttatagccttttcttgaaagagagaatcacatttcttggatcactcttaagcatctgtgagtgactgaacagtattcaaccctgtttataccacagagcctagcatatgcatatataatgatattggctcaaataaatatttacctgctggtcggctttggtgacacattagaagcagtcagtcatggtatgttttatgctattgtaaaggagtatagctactatttatttcaagggaggtttgaatttaaagatcttggtagcataaatccgatctagcaatttgcctcagtttacctgtccattatcatccaggagatgtctgtattcaggtgggatagtgtcatctctttctccaagcttgtctctatgttcagctttagctttttcctatatcaacagtgagcagatagaattaatattcatttcctctttcacttagaaaatacattgtcaaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggaaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctccgctggtatctctgtcacagattcagtgaccttcccctccagtggagtacagattgatttttctatttcattataatttcatgtttaaaatataggttaagttcacatcaatattcctatgacaatgacagagtcaagacccaaggattaaaatttcactattagtgaattttttttttttttttttttttttttacctttactttatcttccattggtttgttctcatctgggtcaggctgcctttgtcctagactgtcagagagtttatccaaggcatcatcgaggtctttgtcactctgctgaaaagtaaataatgctgaattagtcactcattagccaaactgtatcagaggcaaattagcccaggaactccatcttttcaggagggaacctgtttccttggaagaaaaagacatctggggctggggcaggggagtagacagggtcagagaagagaagcctaggaatggaagatcaggagaagagcggcagtatctgtcaccctactggggttggagggccagcaccttccacccaaccctgcccatctcttggtgaagatcccaccaggttaaggaggtcttagtggcagcctcaggagccatatccagtgggtgacctggaggtcacataaagggtccaaaagcaaatgaaccaatcatgtgtgcctttcatttagaaattaaacaccattagaaaactggatatgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggacaacaatatcactgtaactaagatagcttatttcctctaacatttatttactgtatgattcaggcagcttatttaacccctttcagcttcagtttccttggccgtgaaatgtgaataatagtagtacttatactcctaagttgctgagaaaagtaaatgattgaaaaggcatttaaaacaatactagttgtatgttaggacccaacaaatggtaaattattattagtattattatagcaaaatccatatttttcaacacattgcattcaaaattccacctctaaatgaattcaattaaaatgtgtttaatatctacattgtataagacaccatgctgaactctgtccaatactgtatagaactttccagttgattttcaaaatgttttcacatacactatccagttttatttgatgcccacaatggttctcagtgaactaagcaggctttttttttttgaggtaaaaagctcagggaagctaagtcagttgcttgaaaacaaattgttaaaaagtgaatagaacccaggtcttgggactgataaagcttttccctgtcatgcttagtcacatccatgatcttctattttctttgaagcagttttcctgttggagtgattttattacacagatctttgaaatcatgtcttcaaatgctttcagtgtatgtaacactgttagtaacaatctaataatcacagcaaagaaagctcccgtgaattatcatggtttatttgactcttcgatttcctaatatttttatctaaataaagctttataccttgttttagtgacatcttcaaataaaatgttaactaaaaacaagcctctctgatgggaaatgtgatcagagaagtgtcattgtaaaacctacttcttaaaggcaaaaaagtttttgattgcaaatgtttactgatagccttcatcagggcagaatctctggcctgaatattaagaactgaagtgtaaacggcagcctaggctattaatgattcttcctttctgttgcatggggactttcttcattgtgggtgtgtttacatacacacatgcacatgcacatgcacatacacacacacggggcattttactggttttaagtgctttattataatccaggattatagctgctaatggtagagctgcccggggccaggtctgggctttgtcatttgtgcctctggatattttcagatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 4 - DNA, 47291 bp, Homo sapiens
  source 1..47291: mol_type = genomic DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctggtggggtgggatgcgcgggccgtgtgtgttcttaaggtcacttccctccctgcttctcctgttcttctggtcagcaattctctctctccccttcgctctggctctggctgggttttattcagataaagcacctctgttgacgcaaattaaaagtttcctatctgggtgcctcactggccaggtggtcctacaaagttaattccatgaggggaagggggagagcacacacttcctcacgcttttggatttctttgtgtaggctaggttcagaaagaaattatctgtttcctattaaacacccagaggattcgctctgaactcaggacgtggtcaacaattaacaaaacaacaaaacaaaacaaaacaaaacaaaaaacttgaaaattgggcacagttgtctcttgcctgaggatttttaattagtataagtagcacattttcaggtgcggcctgaatagaaacattctagtacttttttttttttcaaattaatccagcatttttattatttaccaacagtgcttgttaatttcattgttcaggaaattctggaagaacctcaattacttcttgatgatctatttcatatactatagtgccccaataaaaggaagggaggcagaggttgcagtgagccaagatcgcaccactgcactccagcctgggagacagagcgagactccgtctcaaaaaaaaaaaaaaaaaaaaaaaagagggatcttggtgaagctgaaaaagcagggagtttatactcacacagatgtggattgcattccaacaagttgtgtgaacttagcaaagttacatgaatggttctttgcttcagttaccccaccttgaatgagaataataggctattagagagagtgagcatgtgtaaagtgcctggcactttggaggagcttagtaaatattagttctttttcctccttggcttctattcctttaagtgttagtggagtgtaacttcaaagagaattgtacttctcttgggaagagctgcttatattgagtagactactgtttttgagagctttctttttttttaactgcctccctttcagaaaattgttagtaaaaccagaccctaggagaccagccagaaccatgaaatgccatgtttcaaactggaacacttactattggaagcaaagccaaacaagagctaatttttcaggggaagagccaaacacacgaacatgatcacagaatcttggatgtagcctacagtttgggattaataagagaatttattagtgaagccctttattcactacatggagtttttaccaagccccactcatgcactgcatcctcgttgagacataactgtttctctttggacccctcatggacccaaccctgcaaagcctctgatccaaggtcccggtaccaaccccttccgcagcacatcagcctttctgtcagctcataacgagttggaatttctagatcttctctggggctgttggagaggtctcggggactttcagagtccttacatgcttgaacctgccaccttcacagagtcctctggatcccgtcttggggcaggggcgatgctcattaagctgttgctgccagtaattccatatggaaagcaaaacacaagttccatttactctctagttccccaacttcaagggcaaaaaaatgttctccctgttcacacttcctgtctcacctgggtggtgccttttgaactgggattatgagatttccaagactctctctaatgtgtaggtatcctttctgtttagcctccagattgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagttttttttttttttaaaaaaaaaaaccaaaaaccagaaattaaacaatccgtaaaaccataccccgatcttatcaccataggttccagtttaattgttgtcaataaggacccaggcatcgaaaattttaaaagcttcccaggttacattaatatgcagccagagttaggaaacttgacatctcagagagggagaattccatgtactgtgaacactttgagggatccacattgtaagcttgctacttttcccaactggaacacgaggagtttgggccaatcacttgcattcacctggtatgggcccctcttggcaaacacccattagaaaggtgcgtttgtataaaagaaataaaaacttatgtttgatgcttggggcatggtttgccaacttccttaaaattcacattgccttttttttttttttttaaagacagagtcttgctctgttgccaggctggagtgcagtggtgcaatctcagctcactgcaactctgcctcccaggttcaagcgattctcctgcctcagcctcccaagtaattaggactacaggtgcgcaccaccacacccagctaatttttgtatttttagtagagacgggatttcgccatgttggccaggatggtctcaatctgttgaccttgtgatctgcccacctcatcctcccaaagtgctgggattacaggcgtgagccaccatgcctggcctgaaattcacattgcttttatgtctttaaaatcaatccaggtgattgatacgtttgccacaaactactgggaaaattaagctctttaagctcttcctggctaaataaataggtaattaacttttggcatgacaatttgaggaagacactgatgttattaaaggttaccattacatatacttacaggggaagtggagacctcgttctagtggtggctgccactgtgtcagcatttgatttccagggtactagggtgactttctccaaggtccagtgtcagtggggagtggtgcttgatcagatgttcctctgatatggttctggttttgcttctttcatgagcctggtttcccaaatgtcctgcaactctgtgacccgtgtagtgagccactcaggatcccctaatgattccttttctgcctatatcagccagagcttgttcggttgctttcaaccaagaaccctgacaggtagagttaatttaaactttgaacatcaaatgatgctttctagtacgtgttaatgattgttgctaactgtaaacatctttcttatatgaaaccataacatagggaaggtccttttactttcaggaaaagacctagtacttttggaagtttatgcctatttctgtgaatgctgggtggatacattctgaaattatgctgtgtcaataacattttaatgacatatatttttgcttttgtacatttgtgccgctaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtatttttttttctctttttcttttaaactgcaagtgctgcccacgctaaattcattatttcagattgattgtcttttaaaattccctttgctgttgaactttttcttcagttttgcttttgcatcttctttatagtgttaaaaatggctttttcccttgctttttaaatctcattttaaaattctattttaaccaattttctttcccccagctctatcagagtaaatatctatttgtttatttggttcgatttctgagacataataaacatgtttaattttcctgaactgtgtattagtttcctagggctgttgtaacaaagtaccacagactgggtagctataaacaacaaaatgtattctctctcaggtctggaggctagaagtctgaaatcaaggtgtcagcaggcccgtgctccctccagactctgggtagaatccttccttatatcttcctagcatctagtggtggccgtggatccctggtactccatgcctagcacctgcgtcattctagtttctccctctgttagtcgcatggccattctattttcctatgtcccagtctccatcttcttataaggaaaccagacataccagattagggcccagcctggtggcctcttcttcactccatgatacttgtaaagaccctatgtccaaataaggtcacatgcacagatactacaggttaggacttcagcaaatcctactagcaacatattagaggaaatacttttatctcagttaaaacttttttagagatctcttctcaccttgctttggttctgtttttaaggaggagacttatttgggggagattttatgctcagttttaaaatggaattttatttgttggtagattatactaatttatttttcaaattccatattattttatcaaggtaagaaagtaaaatttatttcactcatagccccctgaactgaccactacttctatttcactggaatattctgccagacttctttctggatatgcatatatattattttatataaatagaattcttatattttctcttttacaaggaaattttttaacttaatatgttgggaagatgttttatataaatgactattactagacatctttttaatgattttattaaaatacatagttgtacattaatatctttaatccctcgggaatggaaatgaaattgtttccaatttttcagtatcaacaacactttgatgagcatttttgtaaattatttctttagaataaatgcctagaagtaaaattggtaagccaaagagcctataaatttttgataaactttgtcattttttcttacccctcaccaatagtgtatattggcagtctttttagagcaaaaaaggtccccaaataaatgatctctttttaatttacgtaactttgattaaggaagttgagcagcttttgatatgtttgttaatgatttataggttcttcttttatgaattgcctgttaatgacctttgactttgcctgagattcccttggttgttggggattttttttttttttttttttttttttttgtcgagacggagtcttgctctgtcacccaggctggagtgcagtggcgcgaactcggctcaccgcaacctccgcctcccgggttcaagcaattctcctgcctcagcctcctgagtagctgggattacagacgcgcaccaccacacccagctaatttttgtatttttagtagagatggggtttcaccatgttggccagggtggtctcgaactcctgtcctcgtgatccgcccgcctaggcctctcaaagtgccaagattacaggtatgagccatttttaggattacatatttttaggatctcactatctgttaaggctattaagttttcctcacatacttcttaaatgaattttccctgttttttactttttctttttaacttttttttttttcttcccgagacagggtctggttctgtcgcccaggctggagtgcaatggcgcaatctcaggtcactgaaacctctgcctcctgggctcaaaccatcgtctcacctctgcctcccaagtagctgggactacaggcctgcaccaccatgcctggctaatttttgtatttttggtagagatggggttttaccatgttgcccaggtaggtctcacactcctgggctcaagtaatcctcccacctcaacctcccaaaaatgtgttaggattacaggcatgagacaccatgaccatgcccagtgtaactcgtcttttaacttagtttatgatagcttttgtcagatgaaatattttttagtagcaaaatccatcaatcttatagtaactttaggaattaaaaagcaaacacctgttttagagttcctggtgcttcatgctcaatttttatttcacttgccttaattttaggatactagcatcaacacaatttgaacccactgcagctagaatggcctttccctgctttgatgaacctgccttcaaagcaagtttctcaatcaaaattagaagagagccaaggcacctagccatctccaatatgccattggtgagtctgcactcctgtgtattttctataggaaaatctactgattctctgtgacttgcactagcccagtgacagtcaacattgggtcacctgttttgttttattgcctggcagatcgttactaacttttcatttataacctatgcttttgtttcaagccatagttatatgtaatcaaagtaaaaattgcacctaaaaatgcaagatttcagtaacagtgccattccaggttatacatgctgataggagggaagtggtataagaaattcaggtcaggtttaaatattagtgcccttcacaaagcactttcaccctcattttctcatatgatcttttaaaatgattttaaaggtaatgctttgtcaataaggccatatttttagcatacagttattttctctaagttacatatactatatagtaatattcattatataatttgtaactgaatgtacaaaattgggcagacagaaaaagagaataaaagtaatcttttccaaatattatggtgctgaaggtaagtcatgatagatagcttagcttccagagggaaactattattccccaatctcaatgcggatgtggacagcattccctctgatttttaaaagtgactagaagatgaccatgccaaatgaataaaactgttcagtaagtgccatcatcctttgattctggtagtttagaaaagcatcagctgggccgtcattctgcagctggtatataacacctcctggaagcacatcctttgttcagagaaactcactggggatcagagtcagagtagaataggctttgcctagagtcctgagggaagaacagctttgtccctgtgctgaccggggaagcaatatcataacatggagagatactgagagccacagaccaacctctagtgtggtgcttctcaaccttaaaactctatacctacctgccttcataccataaggatgccttcctcaaacaagattcggatctcccaccccacgccagagggctatcctctgtaaaaatcactcttctgcaaattcctaccagccaagaacttctgtccccactcccacccttgtatatgaaaagacaagaaacaattatgctattttcctaatataaatttaatatacaggatgtgctttttcaaaatatagtcctctcccccagtattgtggtattactccctgggacagaagtgagttctttaattggtgaatcaaagttctaggagaataaaggaccagggatgggaaggagacaggagagagactgaaggaccaaacaggattagtggagaaatttgtaggctttcagaagggaggcctggagctttggaagcgccacaaagatgctacagtctaaatccatggatatccaggatccacttagtgaagataggaaaacttcttttttttttttgaggataggaaaacttctaatgcaatgttgtccctttggacgggaatacctctcactaacagaaatctaatacgagtagcctgacctcaggctgcagatattgagctgaggggagaacaatggggtctcaaaagatctttttggagaccagaaaaacacaatatataccattggaacattgaagcttttgggcatggggcagaaattaatcacatttaaatttgaattaatttaatcaggttattttcctaataattaacacaactcgagaatggaaatttttggccaggtgtggtggctcatgactgtaatctcggcactttgggaggctgaggcaggtggataacctgaggtcaggagttcaagaccagcctggccaacatggtaaaaccctgtctctacaaaaatacaaaattagctgggcgtggtggcacatgtctgtaatcttagctacttggggggctgaggcaggagagtcgcttgaactctggaggtggaggttgcagtgagtcaagattgtgccattgcactctagcctgggtgacagagtgagactccatctcaaaaaaaaaaaaaaggaaatttttgttgtaggtaggcagaagcagaatgcatttaaaaagaaaagatgatttgggatcctttatgagtaatcctaggctgggtagcagagttggtttgaatgaccaaatagtgaccagaagttggtggctgatgggtattaagaaggatgagggccaggtgaggtggcttatggttgtaatcctaacactttgggaggcagaagaagaggatttcttgaggtcaggagtccaagaccagccagggcaacatagcaagaccctatctctcaaaacaaaaaaaaaagatgaggtcagagcaatagaggtaagtattggattacaggaaaaatgcccgtgaccatggtttcacccagctaattctggctggttctttttccatctccgtgctttttattgctgacgtgttagactttcttctttaggggcagacctctaagactgtacctccatcaactataccccacccttactctctgattgcacttaaaaaggtgattccaatgaagcaaatgaagcaaatctttttttttttttttttttgagatggagtctcgctctgtcatccaggctggagtgcagtggcgtgatctcggctcactgcaagctctgccttccgggttcatgccattctcctgcctcagcctcccgagtagctgggactacaggcacctgccaccacgcccggctaatttttcatatttttagtagagatggggttccaccgtgttagccaggatggtctcaatctccttaccttgtgatccacccgcctcggcctcccaaagtgctgggattacaggtgtgagccactgtgtccggcccaggttactttcagttatacagcagaacagaagctcttttaggtactacagggttatatattttccccgttgcgtatatgctcaacagctcgacattgcattgccagataattctcaaacctgtatttaaggaaaagtggatcagccacatcttggcaaaactcacaatttcagttttgctttgtctcatccgtgttatcaatccacatatgccaaatgtggatttacagtgtattgtaaactttaaaatggtaagttgtatggtatatgaattatatctcaataaaaaagaaattgagtagaactgtttgacgttaatgtctaaattataattagacattggaaagataacttttaaagtaactatagaagcgtcattagacagggtctggctctgtcatccaggcaggagtgcagtggctcaatcttggctcactgcaacctccacctcccaggctcaagccatccttccacctcagcctccccagtagctatgactacaggcacgcaccaccagcaggactaatttttgtattttttttgtagagatagggtttcaccatgttgcttaggctggtcgcaaactcctgagctcaagcattctgcctacctcggactccccaagtgctgggattgatacacttttaatattatgtctgataattaggaaatttatcatgttcactgtattggataattggattacttgataatttgaattattctgattttaggtgaaatctgtgactgttgctgaaggactcatagaagaccattttgatgtcactgtgaagatgagcacctatctggtggccttcatcatttcagattttgagtctgtcagcaagataaccaagagtggagtcaaggtgagcctatgactgtcacatatggtgaccagcttgttctggtttgcttggaactggttttaaaactggaagtctgcctgagcgcagtgggtcgtgcgtgtaaacccaacataaacccaacagtttgggaggctgaggtggaagaatcacttgaggccaggggtttgagaccagcctggacaaaatagtgagaacctgtctctgcaaaaaataaaataaaaaaattagccaggcatggttccttgtgcctgctactagtcctagctactagggaggatcccttgagcccaggagtttgaggcttcaatgaggtatgattgtgcactccagcctgggcaacagagcaaaaccatgtctctaaacaaacaaacaaagacaaaaccaaataccaaaatcctggaagtcctgcatcctgggaaccttctcaatctcaggcaaactgggatggttggccagcctgttgtcacggatgctcatttgtatagtgaggttctaataacaacaacgtggagagagtgtggcctggcctgagtcatgatcctggcttcactgcagtcacttcactgactctctgaccttggccctattccctctgaaacttagtatttacttctttggaaggtataacttggactagatcctgcaatggtctctaaggttgcttctggttatggctttctgcagtttggaagtaaatgttactatctggcaggggatttctggctatggtaaggaagatagagcaacctgcttggaatacccaaaggctttgggccaggtacactggaatgctggagagaaaaatcttgtttcaaggcacacttgttcctcatttgggtactgttgcatagtgggcaacctattcaactgtgtgccgtagctcagaatgcaaacaggtttttctgaggggaggaagggatgctttgtttgaagataccttatgtgtttgtgctggttttcactgaggcctgaatagatggggattccctgctgaattgctttgtgttcctctagtgctgagatttcttattcttgtggaggtatctttacttaactggggatttgaaggtgacgcttgagactcggatgaagggaacattcttaattcagcagtgaaactatcagcaaaaacacccgcccattgctttgccacttatctgaatctcttagaaatgattattttagtaatgtctaatctatattaatatttttaattctttcatttctttaaacacattaagcatacaattatatatctgtgtctggtaattgttttatctgaattctttgtgtatctgattttgtggttcgttgtttctgctggctcttgcttatggtatcttgtttccttgtttgtattatgaattatgtttgtgagcttacgttgcctgagtctaaagtggattattccagagagaaattgtatttgctcttacagagtgtctgggagtacttactggtccagggatcactttacttgtagtttccttgagaaagggtagttatttctagtttacctttacattaaaggcctggcctttgggtactagctttatgcagggattgtatgtcctgttagactttctactttgggcaggccctggacttggtctcttaactcctgagtccttcaatgacataagaaccaaagctcaagtccagctgtgttgggctagtgccggcagggttaaagctggctgcagtgctctcctgacatcagagggtctaactgtcatttcactttggcttctaaatctttctttctcatttgccatcttataaacacatttaagaacactttatacatgttatccagcatttgttgttgttttcagaagggggattaatcaggaacagtcagtattaatgcaagaaatggaattcccaattattttctttaatattggcaaccatatcccacaatatgaagacattaatgtcagtcttctacacaatgtggggagagaagccagttaagatatttgaattcctttctgtgcctttctctttaggtttctgtttatgctgtgccagacaagataaatcaagcagattatgcactggatgctgcggtgactcttctagaattttatgaggattatttcagcataccgtatcccctacccaaacaaggtagagattttgcacagatattacacatgacatttgatgaacacagtcatagatttgtcattataattggcacatccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctttcttacacaagcccttaaaactattgtatgtttgattttttaggtatatgtgggtcttgggcatccaaaatagaatggattattataattgtttagtttttcaatttccaaactcctcatcagaaggttagaaatggagtcaagaggcctgaaaaggcgggcacggtggctcatgtcttgtaatctcagcactttgggaggcccaggcaggtggattacttgagcccaggagtttgaggccagcctgggcaacatggcaaaaccctgtttccacaaaagtacaaaaatattagctgagtgtggaggtgcactcttgtagtcccagctacttgcaaggctgagatgggaggatcacctgagcttgggaggttgaggctgcagtgaggtgtaattataccactgcaaatgcactccagtatgggtgacagagtgggaccttgtttccaaaaaaaaaaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccaggtataagctcattcacacttttaataaagtataaactacatttatattgcttctatgggacatataaggctatttatataatttttactttgtctttttttaataggaaaaattgtttctccaaagcattcgtttttatgtcttataatgcatgttgaactttttttatttttaccttgattaaatattggtcctgtaaatatatgttaacattcataaacttatattggacatctaaaatatacttctttctgagtgtctttgtttatggcttatgttgtgcttttagtggtttgggaacctggtcactatggaatggtggaatgatctttggctaaatgaaggatttgccaaatttatggagtttgtgtctgtcagtgtgacccatcctgaactgaaagttgtaagtagttatttatccttcacatttgaggttaatttgttgttttgttcaatattgctggaaaatattcactaatctttgattatagaacttataaaaatatttcactgataacttccttgacagtttagatatgaatcgtgttgcaaaaatgctagtgaactttcaagatataccacaaagacttatttacaaactcagttgtgaatctatgattgtttgtaaattgtccgattttatatttcttaatatcaaagaaatagaaataatggcagcctaaatgttccatttcattttcccaaccttcaggttgctcattgcagaattattaggtacagattactgatatctcaataggaccctacttgccaaatcaaatgagttatacttaaggtaactgcacatttgattgtataacaacctaggcttctggatcacaaatttattgctttggaactgctatatggtttattttttaaatcaccacatttaacttaagaaaatcacatatagcaaaattaaacttatgtaaaaatttttttatcctactccaatgattcttttcatttgtaaatatttattcctattttcatctgcctgtatacattatttaaaatatacatttgtgaatatttattactgcctattttcatctgcctgtgtacataattagaaagtacacatcaatattgcattataatcctaaatattttcttatgtttctacatgatctttagtaataaaaatgattatggatacatattgtcctgttgagctaatgtgctctaataaagctggttaaggttctccatttattttcattatgtttttaaaggtaagtatctttgctctaaaacagtacagacaatgattggaaatgttgaaattactatacagttaatttcttgttgtgttgctgtttggctataggcataattgtttcgtttttagattaatacgaaattttctttattctaaaggacttaagatgaacaaaatctataatgtttaactaaaatcattgtttcttgggtagcttttagaatatattaattctattttgtttcataaatattaggaaatatggaataggttgcccccaaaatgtgaagtatggacttcttgcctcagataaaatgtcccacctttgacattttttatctaaatgtaaatcataggtgatgttttcttttttctatctcaatagggagattatttctttggcaaatgttttgacgcaatggaggtagatgctttaaattcctcacaccctgtgtctacacctgtggaaaatcctgctcagatccgggagatgtttgatgatgtttcttatgataaggtaaaagtagattgagtataaggatacagtttagatactaaagttatacatactggggtggagaagttataggcaaggttgtggggttaaacccagattgaatgccttctctcttgacacgtgctggctggagtcaactcttttaggactaacttgcagtttggctcataaccctaaagattattttatgggaaattcttcatatattctttcttgggttgaaaattcatggcttacagaaactctgcttttattcatcattcaacaaataggtattgattgagcatcaactttgtactagacaaaaattcctgccctcgtgtagcttacttttcaaggccttcagcaatggttaatattgttgagacgcaaataattgtcttgcacagtgtgcttagtaacagagttgggaattgttgacaacagtttaatgattgggagattttatgtaaaatccagatttctagcttctcttggggaagaaaaaggaggatttggccactgtatgttctttgcagcataagctggagctaagttgttgttctctctttgtaagatcaaggctctgcttttccactttccctgccattcccaactgttctattgtcttctcaccgaggctgagagtgtgttgccagttaccattgtgcttggctgttgttttaccggtagcaaacagaaaagtctttcttgcttgcatgtttccattgaaagtccaggggaaaaagaatgtaaaagagcattcttcttatccttggactacttcccttatttatatgccctgtcatgtgccactggaggcatttgagtttgtgactcaccatccgtggtaatgggagtggaggggaaaagagccctttaccaaggaatacagggtgtctgggaagactcttgttccctttctcattgtgactccagctccatcagccctccatgctcaaggctgcctgggctccctggacatatccacttttccttccctggcatctacctctgcctccatctctagtgctccaccccttgttgtactggcctctccttagtcctgccctggaatggcagtgggagagccaggtagtagctcaaggtccaatgtttaatctgcaccattatccccactcacatgtgaacaaagggagttggcagatgatgctaatttgccccatcgggaggtctggctactgatagaaaataagggcctcagtgggctcagagcataagcaatcacattagacaaatctcctgcctaaacaggtccaggtttaacctgcttactctgtttcacaaattgccagacattaacagtgttcctgcagttgcgttttcaaagaaatgtgttttattgcaaaagaatatgtgatttcagatgagactgcaatgaaactatagataacaattatttctattatcttttcagggagcttgtattctgaatatgctaagggagtatcttagtgctgacgcatttaaaagtggtattgtacagtatctccagaagcatagctataaaaatacaaaaaacgaggacctgtgggatagtatggcaagtgtgagtatgtttttgaatatctctgcatttgggattgacaggcttatcatcttgttttgttttccctgcattatgttaatccctctgaggagaatcattgttttctatagaaataagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttcccttttaaagcagtggatttatgacatgtttctatagcagattacagctgcattgtagcagtcaaaaggatatgtcagtcatttacagagctctgcatttgtacaaagacaatggcactgagcattcttgaatacttgtcatgtgtcaggcacatgttaagcacttatatgtattatctcctttactcttcataataaacctgtgagctgggtactattactatccctatttttaaagttgagaacatgaaatacaaagacatctgattggtaaattgcagagcagagatctgaatttagatctaactcatgtttttaactgctaagctataaagtattcataacatcaagtcacaaaacagcctgagtctctgttcatctggacttgtgggatgttttcagaggaagctgagggtgagtctggagatacaacagaattttttgtttcttttttctttttatatgtttactttcttggcttttttgttcctagagactgctttattcagtagtttctagatttgtcctgtggcacattttatctttttactaattcttttttttttgagacagagtctcactctgttgcccaggctggagtgcagtggcgtgatctcggctcactgtagcctctgcctccccggttccagcgattctcttgcctcagcctcccaggtagccgggattacaggcacacgccactacacccggttaatttttgtattcttagtagagatgaggtttcaccatgttcgccaggctggtcttgaactcctgacctcaggtgatccacccaactcagactccgaaagtgctaggattacaggcatgagccaccgcgcccagcctttactacttcttaaatcatttcttaaaagcttttttagtatcaaaaaacagctccttttgagttcccactatttgttgagtgtgggtcatctctgtgttctcactttagaaacacaggctcttgactgaacattgtttccaccttgcttgtccaaaaccagcatagttaggtaggtattgaaaacctggcactttctctcccttctcttccttcattcattcacatgcctgctttgtgcccagtgttattgccagccccaaagtgtgcccggcagaactaggtatgctacctgtcctccagacacgtatgtgtagtggaggaaaatgacaagcaaacagctggtgctctaatggaggtgtgatggctggggacatcacactgagaaagggatcagaaagtgctcctaagaggggaggttggcaactggtagcggctgtttgagcataagctggtgttctctcttttcttagagttgggttaaatgggtgatgtgtctgcctttttgtgtacacaccagcattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtaatgctcctagagtaaaatttgttttgttgtctaggtaacatctgccttgtaggatggaaccttgcttttgaaataatgcccttaccactattgctaaaatatttcagctgcatctgtgtatcctatgaagttgacttatactccctgcccccatcttcccagtaggattaaggaggctttaaaccttggttattctcagtaaaggtgacgatgtaattactttaacattctcatattttgtaatttgatatgatggtaatttctggttactggcttgaaatcaactccaacctaagcaactgctactagattacaatagtgcctagcatttggttggagctgaggacaaaagaatttaggtgatttccgagaatgatgagagactcagttgtcttcttctgagttagatttggaacctgtttgtcagcttaatgctatagaagaatattattagaaacaagatgctgcaacttgattgaccctggatggataccgttaaaaaattcttttatcttgaaacaatttcagacttatagagaagttacaagaataacacaacaaattcctatatatcctttacctagatacatgttaactctttactcctttactttcttcacctccctctctctcttgctctctctctctctctatatatatatgtatatgtttgtgtggatatatgtgtgtgtgtatatatacatatatatgtgtatatatatacacacacatatatatatataatatatacacctccctcccccatcttcccaaaaggattaaggaggttttaaatcttgattaatcgatatccatctatctacatacatacctatatacatatgtctgtatgtatatacttggcatatgtttttctgaactgtttgacagtaaattggtgacatgattccccttcacacctaaatgtttcagcatagtattttctacaaaacaacatttatggccggtcacagtggctcatgcctttaataccaggactttgggaagccgaggcaggaggatcacctgaggttaggagttcgagaccagcctggccaacatggtgaaacaccatctctactaaaaatacaaaaattagccgggcatggtggcgggcgcctgtagtcccagctactcaggagggtgaggcaggagaatcgcttgtacccaggaggtggaggttgcagtgagccgagatcgcaccactgcactccagcctggacaacaagagcgaaactccatctcaaaacaaacaaacaaaaaacaagaacattcagttatataaccatagccacagtacaattatcaaaattgggaaataaactttatataatactattatctataaatcccattcaactttttccaattgtcctaaaaatatccttatagcaaaatagaaaataaattctgacttaggatttaatacaggatcacttattttatttagttgttgcatcattttggtctccatttttttctgaaacaactcttcagtcttttttgggcttctcgatattgacattttttgaagagtactggccagttattttatagaatgcctttcagtttggattttctgctgtttctccatgatcaggttcagcttacatatcattgacaggaatcccaaggaggtgatattgtgtccttcctaatatactattcaggaggcacatgagtcctgaagttaggcctctgagatgcaatcagccaatcactgtaaaaaggctttcagggttcacgtgagtccaaattcttagctctactcaaggagtccaagaaaaggaaatagtgcccgagctgacactccctacaaagctggaaaacagactggggatgttttgagagcttggctgtagcagttttggtactatcttgttctaaactaaccagtgcctggcacatgataggtgatttaataactgcttgttgaattgaatcaacaaatgaacaatccacctctcctttattttaggtacctgtggcatgttccattgacattcatcaccagcaaatccgacatggtccatcgatttttgctaaaaacaaaaacaggtaatttattttggaaactactagttaattcaaggaggaatgtgaaaatgtgtaggattaaagtgctgtttcttttgctatttatcttggttaaagcaaaagggatcagattgaaaatgctttctggtttcaaagaagaatggccaatatcttgccagatagagattatagctgaattacataatgctaaaaaggagggattaccagtgaacattcactattactttgttaacattactgggttatatcatatgtatggccagagatgtagttgccattcttttcatagatctgtaaatctcacaaaattgatgtctaaagctagtgttagcttttgtctattgagttgctgttttctggtttctgagagaaataagtgatgttttcaaatttttcagtattaaactcttctctaatttccttgcccaatcttggatgagaaaagctttcttcaggcaggggagcaaatggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcaggtaatacacgctgcacaaagtcgcggtttatttctgaaagcagctgttattgttcaaattcttgatttctaaagacaaaaatgattgattgataacaagaagttgaaaggtgttttcctttaagttcttctaacaacccaagattgcttttagtcttataattaacctcctgtctgtgactactaaggcacttgaaggaaggaatctgtatcttaatctttctcattaataattcagatcatactgaggcggaagtgtagataaccaggagatcaacatcctggcgaaactccttgccttgtccccgcggcatggtcccgcagcttcttctggccccgctataccggatcaggtttctcccaccactgggtctttataacagccttgaagtcttcttagaagactaagtgacacaggcccaagttgtttgcattacatttcttgggttaaagaagggatttttttttctttcctaaaccagatacctgaactttgcagcatctttatggaatatagctcataaaatgtagcccaaccaaatgatctctgagtgtgtgaagacagaattaacactaccctttttttttcctcccccatgacaatggtttttaaggaaatgctcccaaagcctaaaactcaaacttcttcaacatgtaggcagacctaaagtcctaagaggaagcatgcaggtgggaaggattatctctttctcctcatacccgtatccttctggcctaaattttgagtgccttctggttcttctcaccaccatactgggcctcctgaagtgagaaaaagcaatgggggagaaagttatgggttgcttacctagctgtttctttctgcctaaaaaattcccctctgtagaatatttctgcttgagccttagagggcttcttcttttttattttttaacttatataatatataccctaccactgaggtttttaacactaaccctctgtaatgaagggtttctaaggatatgcagtgtctttgaaatggagaagaaaatgtgtttcctccaggaactcatggttttgaccagatgatagtctgtttgaccaggcttcctaaagggtctttgatggaaatcccttgcttactctagaagttcaccactcaatccagtgtttcacagggatagatgctgatgtgcttcctttccggcttatccacgttagccctagacgttactgtttgagaaacttcctccctagtgtaaacatgccggatgttgtgttatatgtgatagaaaagagacttatatagtagttatctatctgtttgtttatttattttttggagatggagtctcactctgtcgcccaggctggagtgcagtggtgccatctcagctcaccgcctctgcctcccgggttcaagtgattctccggcctcagcctcccacataccaagtacctgccaccatgcctgcctattttatgtatttttagtagagacggggtttcaccatgttggccaggctggtcttgaactcccgacctcaggtgatccacctgccttggcctcctaaagtgctgggattacaggcatgagccaccgcgcccggccgtagttatctatttataagggacatttatatctgattgcttgttttgctagaagattaaaatatattttgaagcaaaaagttgacttcccggatttacttttaaaccactaaccacagtgtctcttggtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggtaaaagcctgaaataaaagttatgtaattattatttgtgttaaaaagtgttaatcattgtgtgtgtatgtgtgtgtgtgtgtgtgtgtgtgtgtgtgtgtgtgtatctttatatacatattaaggaaaagcaaataaatattagttcagtatttagatggactagcaagattttggttttatttggcactaaaaataggaatggcattcttagactctatttaatttgcatggatttgttatttccttcctttcacaaaccttttatttcattttcctttcctattacaatggctgacgttcagattttctgggactcttcatggtacttgaggaagaggcacaaaattgttatgcttggcaaaatgtcctgaagtcttgttgcataatttgctctcaaaatttagtcatgtaaactctctttgagtttgttttaaaagtcgcaattcatcctgactttaagtagatggatatcttataaaagtttgttatgaaaatatgaaagtcattcatcattatttattgtttttggcccttttataattaaacagtgctgcatgatttatacagtaaaagttagattatgctttaaaaattagcccccatcatctgagaccataatggattatattaacatgaaatgacctgtgacaatactggtccctgtttccctgtacaacgccctcaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgaggtcagtccttactaaataaccaatttgttgatgtgaagggcatcttttctgttttccatcattggtactaaacattagggaaaacaaaaagtttaagtgtctcccctgctgcccttttctggaaaataaattgctttttaagatttatctatgtatctcgtaactttaagaaatgctaggagggaacttctatgcataaaagtcaaatatctggggagttaggatggtatgggaataattctcattttgtataggcaatgcaaaatcttattaaacggtgacagccatgccatagagaaacacatgcattgtattttatagtagtttctttgggcttccaaattccctgacagggatgcatagtaattgctgacactgtctaagcaaggtaggattttaccgtatctggaaatccctattcttgctacacttcagtcctttttacatttggagcttaaaccccacccaggaaacatttatgccaacaacctacatgcttcagcttaaagaaatccaaacagtggtcctactgccgtcctgacttgtgatcatggtgtaaattttgaatatagtttgaatttcttttggcttgaaaggtgatcccctatggagtcacccagcatcattaaagtatttaaatatgtaggtatttataaaaatggcatttcacatttttgagaaggctacttaaaacctaattttagatatttttctcttgccttttttttataaagtgtaactaggccaggcgcggtggctcacgcctgtaatcccagcactttgggaggctgaggtgggtggatcacgaggtcaggggatcaagaccatcctggctaagacggtgaaaccccgtctctactaaaatacaaaaaatgagccgggcatggtggcgggcgcctgtagtcccagctactcgggaggctgaggtaggagaatggcgtgaacccgggagggcggagcttgcaggaaccgatatcgagccacggcactccagcctgggtgacagagcaagactccgtcctaaaaaaaaaaaaaaaaaaaattgtaactgaaggaaatcagtagtttttgtttatatttccaggcatgcttctctgatcatggggaaagttcagcagttcatagttagtcaccattatgcctctaaacatacttactgcacctcagattctcaccgagtgtgttcctttctatagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggtgagtccgtcattcattcatgttcatgtggccaagggaaattagattagattagatcattctggcatctatttttgttttcttggccaggaattgcctatcctgctgggaacatactgcaagtcagcacacatctaatgagaaaggcaaataattagggagaaccaggtgttaggaaaaatatttaaaggtgtatacatttgtgcatctttaaaatgacaacatattaaaaatatttactagagctactcttccttaactattcttttgagcaaatgagagggtatatgagaatgggtgttatgaacactatataaatgttagtttttattatgtagctatagtgggtttatcaggattgtggttacccatttatctttttaacctttgttactggcagacttttttttcttttacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaaaaaaaaatctatatatatatttttaaacataaatgaaaattagctaattaatatggggtagacaaaatactttgagggtgtggtgagttagaaatggattgtcatttagaagttatttttggatgctatggtgttgacagcagcataaatcagttgcaattaaactagtgaaaactgtgcctcttctcagacacgttaagaggtcttagctctgccagtaaaaaccttaggacttgaagaaaattacttgagacaattagtccttgtttaaggatgttaaaagtgggcactgaggtataaatgactgaagtggtcatccagctgttgctaaagaggcaggtccggaatctaggttctttataaaccatccaagttcatggttccctgtcacttattatgtaaccatctaccttcagaaagaatttcaggcagctttaagatccatgtataaaagaaatgttaaaatgaaggacaaaaagatacataatggacaggtgataaccatgtgagggacttatggctgaggataattctcgcaattgtcccctgaatttatcacagacattcctggaagtcaaggaaaaatgaggaatcagtatgagttattctcattgtctggtaaaagagaacatgaagcatacacattttctacaaaagcagacttttcttcagtcctaaactcgaggactttgatgtgtgggccattgagttctgtggtgtcccttctataataaggtttcctatagtaaagttgtggaacaaattttacaaggctcttaaactgtggtacatttagataaaagctgagaggctaatattaatttttttaggagtggttccattgtgtagtctggttacactattttctagcttgagatggggagagagctttggaaatgaaaaagaatgaagggttgttacagtctcgtagcttttttccagttttcagtagcctcatccaggcttgtaaaattaacttgcatataataattcaagcttgaactccagcgaggtctagagcagagatactctgtctgatgactgaagagatgtccaaagccttgaccagaaaggtagtcatctatagacaagatctatagcaacaaagcatttcattcattcacttgtattctcattaattcattcaagacatatatgccacacatggttttaggttatggggctgtaacagtgaacagacagacaaaacctttgctgtcacggagctgaaatttctgctgtgggaatcagacaattacagacaaatcaaccaatgtcaagtagttacatgctctgaagatgaataaggcaaggagagtgattgggatagagggttggtgctgttttataggatgattaggagacatttgagaagatatcgaaggaaatgccaacatctagaggagtattgtgtgcagaggaaatatcaggtgcgaagatcctgaagcagggcatgaaaagtaaagagcccgagatgttatcataatggagagcaaactacggacatataaaatacgggagtcatcctgaatcctttcttccccagacatctaactacgcaagtcctgccggtcttccctcagcacatgcactggatcttgcgcacttctctctgctcttacccccattcaatcctttctcatctcttgccttgcctattgcaatagtgtcctaactggcctcccccttgccactttgccaatagcaaaacattttccacattgaagactgcaagtcagcccataactgaccctggcttcttgaaaccctgcctattgttcttgcagtaaattccaaatccctccttcccatgtgtccatgaccttgaagacctggcttctgaggacctctctggtgccaattcccacaggcgctcctggcttactctctcataacactgtagccactcagcctccttctgctcctgggctaccacatgtttctcctgtctttaagcctctgcactttttattctctctgcctggcttgcccattccccaacttttcactagaaaggggcattttatctttgagaggtctcggctcagatcaccttccccaaaaccatgctgttcaatgcaggccacatctcctcagttactagcatacccctggcatattttcttcatagcagtttatttacagtaatcatatttactgcttgtataccccaaaagactgtaagctccatgaggggaggatgcttgcctgattcactgctgcatcctcagtgtctagcacagtaattacagcagagggatgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaactttatgtggattttatcttgagacaacaatacatgaattgtagattaggataaaaaaaatggcaaggtttgggtcttaccgccataacttgctaagaatcccattccccacagtgtttctataataacatacaaggccaggcccatggagaaagacagcacttacgtggtggaaactgttttgcttggcaaagaaaagactctgcacattctgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgaagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttccataaagccagacgctatacagtgcaaaggctaatgtggcaatagctctaaagacacagttgctgctcaggttttatgtatagataatagaaagcacagtttactaacacagtaaaccaacagagttcaagtcagatgagtaccctaagaattaattagattttatttcttatgctcgaaatttgctacacaaggacttatctaacctttattttgctctgttgctgacttgattcaagtctcagtgtgttctgtgctgactgtaagatgcagaagtcctcacacctggcaaagaagagttcaaactgaaaaggggtttggtgcttcctggtttgtccaggttacctgttattaatttattattagcagcccaagaggagatatgtgcccaatgtacaatatcttatgtttgacttataaacattatcccaaagcaacatcaaatacagttcaaaagcccaagaggaaagggggtaataagaaatcagaacactgaagaatgtttaaaacattgttttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccagctgaagattttacatgcagataccttaaaaatttcaaataaaaaatgcagtgaatcatttaatatgtaattttcttgttacagacatagtaaatataccacttagcaaaagcattgtataacagacagaaggaatttcctataagtaaacatgaaagtggattaatagaattttttttaattttgggaaaaatgttagagcagttctacctaatatagctccttttttcctaggaaataaacatggatcatggtgagagagctgaacccgatttaacctatactttgatttcttttaggctttggtcagtaagtgcttgtatgcttttaaggcttacattaagccctctcctttctgaagattaagataagggcccagttctgaagatctcagaaatcccttcaatctgtccagtttcttcagcaattataaattagaatcaaacacagtactttactttccaaaataatgacaaataaaaatggccaatcttttcctttgcccttgttcccaaaaccctgtaatttccaccagactctaaagggtacttctccccaccccaccatgtattggtattctggggaatgccaatgtcttcaggacatttcgctaagttgtaacatgctaattttgctttgccacaataacctgcagtaatgagcatttggatttcaaagattcaactagcctcagatggtcattctaagtgcctggcctaatatttttaaaagcttttaattataagattaaggtttttaaacatttcaatagcaaactcatcccatttagtgctttcagagaatgaccaattactctgtagatcttgcagtatgcatttcatgccaatactgtaaagtgagcatgaattactcaagaggtggacttcacttctctcatctataacacataaattggcagaagatacagttgtcttcatttacaaataaacacccaacttaccagataccttaacttgtatttctttagtcatcttttggcttggaagtttcctctgttgtctaaaagggaaagcaaaaccatccgtgagctttcttttctgtattaagtatgaggagatggccttctcagaattaggggacaaaagatggcagtcagtggggaaaaataagatggtcctttcagtttctcttcttcatctggccacaatattgtgagttcttcctcctcaagcttataagctaaaaataaccttaagtgatcctgatcctaaatgtatcactctcagctttatttttttaaggctagggtaggttataaaatatgcataggtgttcttaaatggcaatgtttcattctgtggtgatccttcctttcctgtacatagggtcatggctgtccagtaaatccactcatcataaagggttattatgctttctattatttgttaaagggctgattaagtacttcgtataactgaaattaaataataggcaaataagtatttaaactgagatataatggcataactgccaattatcaatgctgtttcctatatcccttaagggaatctactacaggaagattttaatatattgttttaaaagctttggtgtaactggactattgtctttaaagctacacctttaactcctccttatagccaggggatcatagtaataatcatttaaatcatatgttcttggaattggaagggacctagaagttgtctaatccaattttcatttctcatcacagcttgagtaattttaataataggaagtttccaacttccatgttctaaaatctatataaaccacatactatggtggtattttaattagggcaagaaagacaggcaaaacacaggcaaattgggttgtgtcaagaacattcatttaggattttaaagcaccagttacttaaaaatatatgtatttatacaaattcaattactttaccaagcgatgctatgggatagatagtactttaagaaattttattctaaatagattccagtaggaaactaaatgactgaaatgataaaccctactctgtgtaactgctaaactaatttgtagtatatttactgctccatttacctttgctgaatccttcgctttacctccattcttaggtgctttggagctggaagcagccttcttgcacttatcctaaagcaaaggaaatgtaatgaggctatggctatcaccaatccatctagcaattaactaggctgcagttaaattaatccagaccattctgagatctccaatttaattaaataatggaagactttgggtgttttttcatgattttttttgaacaacggtgtcagagaattgtttaaagcaggagggaaaaaggatagaaataaggagggaaatgtgggtgacattgatgctctaattcccgtggtgcctgactcacccagaccttattttgctaatcaaaacagagcttgtcaatagataataaatgtcggcaagggtgtggagaaaagggaaccctagtacactgtcagtggggatgtagattggtatgggctatgatggaaaacagtatataggttcctaaagaaattaaaagtagaactactgtatgacccagtaatccctcttctgggtatatacccaaaggagatgaaattatcaccttataaagatatctgcactcccatattcactgcaacattactcacaatagccaagatatggaacaacctagttgttgatgaatggataaagaaaatgtcatgtatatatacataatggaatattattcagccttaaaaaacgatatcctactatttgtcacaacatggatggacctggaagaccttatactagatgatataagccagacacagaaagaaaagtgatttcacttatatgtagaatatatataaaagaaaaagctcaaaaacacagagaataaaacatggcgaccatggtagggaacaggaggaggaaacagagatataggtcaaaggatacaaaatagcagatatgcagaatgaacaagtgtagagagttaatgtataacatgaggactaaggttaataaaattgtattagggattttgttaactaagtagattttagctgcttttgtcacaaaaagtagttgtgtgagaatgatagatatgtaaatctgcttccctacagtaaccattttattatttctatgcatcccaaactaccatgttgtaaacctcaaatatacacaataaaatgtatttaaaaaacaaaatagagcttgtctcgatcaggactggcttttgtgtaccaaaaggcaaaaaaaaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatagaaaaaaaaggaaatccacaaaataatactgttttgggggcagtggaattataggcattttttcttttcttcattttcaggttctctatatcatcgtttgattcattctacagtttaaaaattgtaagggccaggcgcagtggctcaagcctgtaatcccagtactttgggaggtagaggttggcagatcacttgagcccaagagctcgagaccagcctggcaacatggcgaaaccccctctctacaaaaaaatacaaaaattagctgggtgtggtggtgcacgcctgtagtcccagctactcaggaagctaaggtaggaggattgcttgagcccaggaagcagagatcgcagtaagctgagatcacaccactgcactccagcctgggctatagagtaagaccctgttacaagacagaccgatagatagatcaatcaataaataaaacttatatgtatgtacacatacacacacacacatttcaaagagtgaaatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtggaattgctatcttgaggaatactgaatgcaagcaaggagaattggttcctgtaataggagaccctgaagctgacactgctatttaaaccaggaatcatcttactcaccaaaatgaatcagtacagaaagagaagggtgtaatttggtcttccttgtttcttatttgatgaacaggcatggaaagggttatttatcatctaattgactcaaaaattagaaactaaataggaaagaggtgggggacaggcctggttgacctacgaaagactggcctctatcatgtgggagacaaaaggccagggactttttggcagagaaacaggatttgtgattgggaatattgctttgcctgtcttcacttgcaatagtgctgatgatgatgcaggagaagatagggagaccccaggtcttggagctgccttattaattttccctattaattatcccaacaccagctccttttctgctctccttaaacagagattgcttcctttgaaatcctatcaccttagtcatttttatagccttttcttgaaagagagaatcacatttcttggatcactcttaagcatctgtgagtgactgaacagtattcaaccctgtttataccacagagcctagcatatgcatatataatgatattggctcaaataaatatttacctgctggtcggctttggtgacacattagaagcagtcagtcatggtatgttttatgctattgtaaaggagtatagctactatttatttcaagggaggtttgaatttaaagatcttggtagcataaatccgatctagcaatttgcctcagtttacctgtccattatcatccaggagatgtctgtattcaggtgggatagtgtcatctctttctccaagcttgtctctatgttcagctttagctttttcctatatcaacagtgagcagatagaattaatattcatttcctctttcacttagaaaatacattgtcaaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggaaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctccgctggtatctctgtcacagattcagtgaccttcccctccagtggagtacagattgatttttctatttcattataatttcatgtttaaaatataggttaagttcacatcaatattcctatgacaatgacagagtcaagacccaaggattaaaatttcactattagtgaattttttttttttttttttttttttttacctttactttatcttccattggtttgttctcatctgggtcaggctgcctttgtcctagactgtcagagagtttatccaaggcatcatcgaggtctttgtcactctgctgaaaagtaaataatgctgaattagtcactcattagccaaactgtatcagaggcaaattagcccaggaactccatcttttcaggagggaacctgtttccttggaagaaaaagacatctggggctggggcaggggagtagacagggtcagagaagagaagcctaggaatggaagatcaggagaagagcggcagtatctgtcaccctactggggttggagggccagcaccttccacccaaccctgcccatctcttggtgaagatcccaccaggttaaggaggtcttagtggcagcctcaggagccatatccagtgggtgacctggaggtcacataaagggtccaaaagcaaatgaaccaatcatgtgtgcctttcatttagaaattaaacaccattagaaaactggatatgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggacaacaatatcactgtaactaagatagcttatttcctctaacatttatttactgtatgattcaggcagcttatttaacccctttcagcttcagtttccttggccgtgaaatgtgaataatagtagtacttatactcctaagttgctgagaaaagtaaatgattgaaaaggcatttaaaacaatactagttgtatgttaggacccaacaaatggtaaattattattagtattattatagcaaaatccatatttttcaacacattgcattcaaaattccacctctaaatgaattcaattaaaatgtgtttaatatctacattgtataagacaccatgctgaactctgtccaatactgtatagaactttccagttgattttcaaaatgttttcacatacactatccagttttatttgatgcccacaatggttctcagtgaactaagcaggctttttttttttgaggtaaaaagctcagggaagctaagtcagttgcttgaaaacaaattgttaaaaagtgaatagaacccaggtcttgggactgataaagcttttccctgtcatgcttagtcacatccatgatcttctattttctttgaagcagttttcctgttggagtgattttattacacagatctttgaaatcatgtcttcaaatgctttcagtgtatgtaacactgttagtaacaatctaataatcacagcaaagaaagctcccgtgaattatcatggtttatttgactcttcgatttcctaatatttttatctaaataaagctttataccttgttttagtgacatcttcaaataaaatgttaactaaaaacaagcctctctgatgggaaatgtgatcagagaagtgtcattgtaaaacctacttcttaaaggcaaaaaagtttttgattgcaaatgtttactgatagccttcatcagggcagaatctctggcctgaatattaagaactgaagtgtaaacggcagcctaggctattaatgattcttcctttctgttgcatggggactttcttcattgtgggtgtgtttacatacacacatgcacatgcacatgcacatacacacacacggggcattttactggttttaagtgctttattataatccaggattatagctgctaatggtagagctgcccggggccaggtctgggctttgtcatttgtgcctctggatattttcagatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 5 - DNA, 47291 bp, Homo sapiens
  source 1..47291: mol_type = genomic DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctggtggggtgggatgcgcgggccgtgtgtgttcttaaggtcacttccctccctgcttctcctgttcttctggtcagcaattctctctctccccttcgctctggctctggctgggttttattcagataaagcacctctgttgacgcaaattaaaagtttcctatctgggtgcctcactggccaggtggtcctacaaagttaattccatgaggggaagggggagagcacacacttcctcacgcttttggatttctttgtgtaggctaggttcagaaagaaattatctgtttcctattaaacacccagaggattcgctctgaactcaggacgtggtcaacaattaacaaaacaacaaaacaaaacaaaacaaaacaaaaaacttgaaaattgggcacagttgtctcttgcctgaggatttttaattagtataagtagcacattttcaggtgcggcctgaatagaaacattctagtacttttttttttttcaaattaatccagcatttttattatttaccaacagtgcttgttaatttcattgttcaggaaattctggaagaacctcaattacttcttgatgatctatttcatatactatagtgccccaataaaaggaagggaggcagaggttgcagtgagccaagatcgcaccactgcactccagcctgggagacagagcgagactccgtctcaaaaaaaaaaaaaaaaaaaaaaaagagggatcttggtgaagctgaaaaagcagggagtttatactcacacagatgtggattgcattccaacaagttgtgtgaacttagcaaagttacatgaatggttctttgcttcagttaccccaccttgaatgagaataataggctattagagagagtgagcatgtgtaaagtgcctggcactttggaggagcttagtaaatattagttctttttcctccttggcttctattcctttaagtgttagtggagtgtaacttcaaagagaattgtacttctcttgggaagagctgcttatattgagtagactactgtttttgagagctttctttttttttaactgcctccctttcagaaaattgttagtaaaaccagaccctaggagaccagccagaaccatgaaatgccatgtttcaaactggaacacttactattggaagcaaagccaaacaagagctaatttttcaggggaagagccaaacacacgaacatgatcacagaatcttggatgtagcctacagtttgggattaataagagaatttattagtgaagccctttattcactacatggagtttttaccaagccccactcatgcactgcatcctcgttgagacataactgtttctctttggacccctcatggacccaaccctgcaaagcctctgatccaaggtcccggtaccaaccccttccgcagcacatcagcctttctgtcagctcataacgagttggaatttctagatcttctctggggctgttggagaggtctcggggactttcagagtccttacatgcttgaacctgccaccttcacagagtcctctggatcccgtcttggggcaggggcgatgctcattaagctgttgctgccagtaattccatatggaaagcaaaacacaagttccatttactctctagttccccaacttcaagggcaaaaaaatgttctccctgttcacacttcctgtctcacctgggtggtgccttttgaactgggattatgagatttccaagactctctctaatgtgtaggtatcctttctgtttagcctccagattgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagttttttttttttttaaaaaaaaaaaccaaaaaccagaaattaaacaatccgtaaaaccataccccgatcttatcaccataggttccagtttaattgttgtcaataaggacccaggcatcgaaaattttaaaagcttcccaggttacattaatatgcagccagagttaggaaacttgacatctcagagagggagaattccatgtactgtgaacactttgagggatccacattgtaagcttgctacttttcccaactggaacacgaggagtttgggccaatcacttgcattcacctggtatgggcccctcttggcaaacacccattagaaaggtgcgtttgtataaaagaaataaaaacttatgtttgatgcttggggcatggtttgccaacttccttaaaattcacattgccttttttttttttttttaaagacagagtcttgctctgttgccaggctggagtgcagtggtgcaatctcagctcactgcaactctgcctcccaggttcaagcgattctcctgcctcagcctcccaagtaattaggactacaggtgcgcaccaccacacccagctaatttttgtatttttagtagagacgggatttcgccatgttggccaggatggtctcaatctgttgaccttgtgatctgcccacctcatcctcccaaagtgctgggattacaggcgtgagccaccatgcctggcctgaaattcacattgcttttatgtctttaaaatcaatccaggtgattgatacgtttgccacaaactactgggaaaattaagctctttaagctcttcctggctaaataaataggtaattaacttttggcatgacaatttgaggaagacactgatgttattaaaggttaccattacatatacttacaggggaagtggagacctcgttctagtggtggctgccactgtgtcagcatttgatttccagggtactagggtgactttctccaaggtccagtgtcagtggggagtggtgcttgatcagatgttcctctgatatggttctggttttgcttctttcatgagcctggtttcccaaatgtcctgcaactctgtgacccgtgtagtgagccactcaggatcccctaatgattccttttctgcctatatcagccagagcttgttcggttgctttcaaccaagaaccctgacaggtagagttaatttaaactttgaacatcaaatgatgctttctagtacgtgttaatgattgttgctaactgtaaacatctttcttatatgaaaccataacatagggaaggtccttttactttcaggaaaagacctagtacttttggaagtttatgcctatttctgtgaatgctgggtggatacattctgaaattatgctgtgtcaataacattttaatgacatatatttttgcttttgtacatttgtgccgctaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtatttttttttctctttttcttttaaactgcaagtgctgcccacgctaaattcattatttcagattgattgtcttttaaaattccctttgctgttgaactttttcttcagttttgcttttgcatcttctttatagtgttaaaaatggctttttcccttgctttttaaatctcattttaaaattctattttaaccaattttctttcccccagctctatcagagtaaatatctatttgtttatttggttcgatttctgagacataataaacatgtttaattttcctgaactgtgtattagtttcctagggctgttgtaacaaagtaccacagactgggtagctataaacaacaaaatgtattctctctcaggtctggaggctagaagtctgaaatcaaggtgtcagcaggcccgtgctccctccagactctgggtagaatccttccttatatcttcctagcatctagtggtggccgtggatccctggtactccatgcctagcacctgcgtcattctagtttctccctctgttagtcgcatggccattctattttcctatgtcccagtctccatcttcttataaggaaaccagacataccagattagggcccagcctggtggcctcttcttcactccatgatacttgtaaagaccctatgtccaaataaggtcacatgcacagatactacaggttaggacttcagcaaatcctactagcaacatattagaggaaatacttttatctcagttaaaacttttttagagatctcttctcaccttgctttggttctgtttttaaggaggagacttatttgggggagattttatgctcagttttaaaatggaattttatttgttggtagattatactaatttatttttcaaattccatattattttatcaaggtaagaaagtaaaatttatttcactcatagccccctgaactgaccactacttctatttcactggaatattctgccagacttctttctggatatgcatatatattattttatataaatagaattcttatattttctcttttacaaggaaattttttaacttaatatgttgggaagatgttttatataaatgactattactagacatctttttaatgattttattaaaatacatagttgtacattaatatctttaatccctcgggaatggaaatgaaattgtttccaatttttcagtatcaacaacactttgatgagcatttttgtaaattatttctttagaataaatgcctagaagtaaaattggtaagccaaagagcctataaatttttgataaactttgtcattttttcttacccctcaccaatagtgtatattggcagtctttttagagcaaaaaaggtccccaaataaatgatctctttttaatttacgtaactttgattaaggaagttgagcagcttttgatatgtttgttaatgatttataggttcttcttttatgaattgcctgttaatgacctttgactttgcctgagattcccttggttgttggggattttttttttttttttttttttttttttgtcgagacggagtcttgctctgtcacccaggctggagtgcagtggcgcgaactcggctcaccgcaacctccgcctcccgggttcaagcaattctcctgcctcagcctcctgagtagctgggattacagacgcgcaccaccacacccagctaatttttgtatttttagtagagatggggtttcaccatgttggccagggtggtctcgaactcctgtcctcgtgatccgcccgcctaggcctctcaaagtgccaagattacaggtatgagccatttttaggattacatatttttaggatctcactatctgttaaggctattaagttttcctcacatacttcttaaatgaattttccctgttttttactttttctttttaacttttttttttttcttcccgagacagggtctggttctgtcgcccaggctggagtgcaatggcgcaatctcaggtcactgaaacctctgcctcctgggctcaaaccatcgtctcacctctgcctcccaagtagctgggactacaggcctgcaccaccatgcctggctaatttttgtatttttggtagagatggggttttaccatgttgcccaggtaggtctcacactcctgggctcaagtaatcctcccacctcaacctcccaaaaatgtgttaggattacaggcatgagacaccatgaccatgcccagtgtaactcgtcttttaacttagtttatgatagcttttgtcagatgaaatattttttagtagcaaaatccatcaatcttatagtaactttaggaattaaaaagcaaacacctgttttagagttcctggtgcttcatgctcaatttttatttcacttgccttaattttaggatactagcatcaacacaatttgaacccactgcagctagaatggcctttccctgctttgatgaacctgccttcaaagcaagtttctcaatcaaaattagaagagagccaaggcacctagccatctccaatatgccattggtgagtctgcactcctgtgtattttctataggaaaatctactgattctctgtgacttgcactagcccagtgacagtcaacattgggtcacctgttttgttttattgcctggcagatcgttactaacttttcatttataacctatgcttttgtttcaagccatagttatatgtaatcaaagtaaaaattgcacctaaaaatgcaagatttcagtaacagtgccattccaggttatacatgctgataggagggaagtggtataagaaattcaggtcaggtttaaatattagtgcccttcacaaagcactttcaccctcattttctcatatgatcttttaaaatgattttaaaggtaatgctttgtcaataaggccatatttttagcatacagttattttctctaagttacatatactatatagtaatattcattatataatttgtaactgaatgtacaaaattgggcagacagaaaaagagaataaaagtaatcttttccaaatattatggtgctgaaggtaagtcatgatagatagcttagcttccagagggaaactattattccccaatctcaatgcggatgtggacagcattccctctgatttttaaaagtgactagaagatgaccatgccaaatgaataaaactgttcagtaagtgccatcatcctttgattctggtagtttagaaaagcatcagctgggccgtcattctgcagctggtatataacacctcctggaagcacatcctttgttcagagaaactcactggggatcagagtcagagtagaataggctttgcctagagtcctgagggaagaacagctttgtccctgtgctgaccggggaagcaatatcataacatggagagatactgagagccacagaccaacctctagtgtggtgcttctcaaccttaaaactctatacctacctgccttcataccataaggatgccttcctcaaacaagattcggatctcccaccccacgccagagggctatcctctgtaaaaatcactcttctgcaaattcctaccagccaagaacttctgtccccactcccacccttgtatatgaaaagacaagaaacaattatgctattttcctaatataaatttaatatacaggatgtgctttttcaaaatatagtcctctcccccagtattgtggtattactccctgggacagaagtgagttctttaattggtgaatcaaagttctaggagaataaaggaccagggatgggaaggagacaggagagagactgaaggaccaaacaggattagtggagaaatttgtaggctttcagaagggaggcctggagctttggaagcgccacaaagatgctacagtctaaatccatggatatccaggatccacttagtgaagataggaaaacttcttttttttttttgaggataggaaaacttctaatgcaatgttgtccctttggacgggaatacctctcactaacagaaatctaatacgagtagcctgacctcaggctgcagatattgagctgaggggagaacaatggggtctcaaaagatctttttggagaccagaaaaacacaatatataccattggaacattgaagcttttgggcatggggcagaaattaatcacatttaaatttgaattaatttaatcaggttattttcctaataattaacacaactcgagaatggaaatttttggccaggtgtggtggctcatgactgtaatctcggcactttgggaggctgaggcaggtggataacctgaggtcaggagttcaagaccagcctggccaacatggtaaaaccctgtctctacaaaaatacaaaattagctgggcgtggtggcacatgtctgtaatcttagctacttggggggctgaggcaggagagtcgcttgaactctggaggtggaggttgcagtgagtcaagattgtgccattgcactctagcctgggtgacagagtgagactccatctcaaaaaaaaaaaaaaggaaatttttgttgtaggtaggcagaagcagaatgcatttaaaaagaaaagatgatttgggatcctttatgagtaatcctaggctgggtagcagagttggtttgaatgaccaaatagtgaccagaagttggtggctgatgggtattaagaaggatgagggccaggtgaggtggcttatggttgtaatcctaacactttgggaggcagaagaagaggatttcttgaggtcaggagtccaagaccagccagggcaacatagcaagaccctatctctcaaaacaaaaaaaaaagatgaggtcagagcaatagaggtaagtattggattacaggaaaaatgcccgtgaccatggtttcacccagctaattctggctggttctttttccatctccgtgctttttattgctgacgtgttagactttcttctttaggggcagacctctaagactgtacctccatcaactataccccacccttactctctgattgcacttaaaaaggtgattccaatgaagcaaatgaagcaaatctttttttttttttttttttgagatggagtctcgctctgtcatccaggctggagtgcagtggcgtgatctcggctcactgcaagctctgccttccgggttcatgccattctcctgcctcagcctcccgagtagctgggactacaggcacctgccaccacgcccggctaatttttcatatttttagtagagatggggttccaccgtgttagccaggatggtctcaatctccttaccttgtgatccacccgcctcggcctcccaaagtgctgggattacaggtgtgagccactgtgtccggcccaggttactttcagttatacagcagaacagaagctcttttaggtactacagggttatatattttccccgttgcgtatatgctcaacagctcgacattgcattgccagataattctcaaacctgtatttaaggaaaagtggatcagccacatcttggcaaaactcacaatttcagttttgctttgtctcatccgtgttatcaatccacatatgccaaatgtggatttacagtgtattgtaaactttaaaatggtaagttgtatggtatatgaattatatctcaataaaaaagaaattgagtagaactgtttgacgttaatgtctaaattataattagacattggaaagataacttttaaagtaactatagaagcgtcattagacagggtctggctctgtcatccaggcaggagtgcagtggctcaatcttggctcactgcaacctccacctcccaggctcaagccatccttccacctcagcctccccagtagctatgactacaggcacgcaccaccagcaggactaatttttgtattttttttgtagagatagggtttcaccatgttgcttaggctggtcgcaaactcctgagctcaagcattctgcctacctcggactccccaagtgctgggattgatacacttttaatattatgtctgataattaggaaatttatcatgttcactgtattggataattggattacttgataatttgaattattctgattttaggtgaaatctgtgactgttgctgaaggactcatagaagaccattttgatgtcactgtgaagatgagcacctatctggtggccttcatcatttcagattttgagtctgtcagcaagataaccaagagtggagtcaaggtgagcctatgactgtcacatatggtgaccagcttgttctggtttgcttggaactggttttaaaactggaagtctgcctgagcgcagtgggtcgtgcgtgtaaacccaacataaacccaacagtttgggaggctgaggtggaagaatcacttgaggccaggggtttgagaccagcctggacaaaatagtgagaacctgtctctgcaaaaaataaaataaaaaaattagccaggcatggttccttgtgcctgctactagtcctagctactagggaggatcccttgagcccaggagtttgaggcttcaatgaggtatgattgtgcactccagcctgggcaacagagcaaaaccatgtctctaaacaaacaaacaaagacaaaaccaaataccaaaatcctggaagtcctgcatcctgggaaccttctcaatctcaggcaaactgggatggttggccagcctgttgtcacggatgctcatttgtatagtgaggttctaataacaacaacgtggagagagtgtggcctggcctgagtcatgatcctggcttcactgcagtcacttcactgactctctgaccttggccctattccctctgaaacttagtatttacttctttggaaggtataacttggactagatcctgcaatggtctctaaggttgcttctggttatggctttctgcagtttggaagtaaatgttactatctggcaggggatttctggctatggtaaggaagatagagcaacctgcttggaatacccaaaggctttgggccaggtacactggaatgctggagagaaaaatcttgtttcaaggcacacttgttcctcatttgggtactgttgcatagtgggcaacctattcaactgtgtgccgtagctcagaatgcaaacaggtttttctgaggggaggaagggatgctttgtttgaagataccttatgtgtttgtgctggttttcactgaggcctgaatagatggggattccctgctgaattgctttgtgttcctctagtgctgagatttcttattcttgtggaggtatctttacttaactggggatttgaaggtgacgcttgagactcggatgaagggaacattcttaattcagcagtgaaactatcagcaaaaacacccgcccattgctttgccacttatctgaatctcttagaaatgattattttagtaatgtctaatctatattaatatttttaattctttcatttctttaaacacattaagcatacaattatatatctgtgtctggtaattgttttatctgaattctttgtgtatctgattttgtggttcgttgtttctgctggctcttgcttatggtatcttgtttccttgtttgtattatgaattatgtttgtgagcttacgttgcctgagtctaaagtggattattccagagagaaattgtatttgctcttacagagtgtctgggagtacttactggtccagggatcactttacttgtagtttccttgagaaagggtagttatttctagtttacctttacattaaaggcctggcctttgggtactagctttatgcagggattgtatgtcctgttagactttctactttgggcaggccctggacttggtctcttaactcctgagtccttcaatgacataagaaccaaagctcaagtccagctgtgttgggctagtgccggcagggttaaagctggctgcagtgctctcctgacatcagagggtctaactgtcatttcactttggcttctaaatctttctttctcatttgccatcttataaacacatttaagaacactttatacatgttatccagcatttgttgttgttttcagaagggggattaatcaggaacagtcagtattaatgcaagaaatggaattcccaattattttctttaatattggcaaccatatcccacaatatgaagacattaatgtcagtcttctacacaatgtggggagagaagccagttaagatatttgaattcctttctgtgcctttctctttaggtttctgtttatgctgtgccagacaagataaatcaagcagattatgcactggatgctgcggtgactcttctagaattttatgaggattatttcagcataccgtatcccctacccaaacaaggtagagattttgcacagatattacacatgacatttgatgaacacagtcatagatttgtcattataattggcacatccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctttcttacacaagcccttaaaactattgtatgtttgattttttaggtatatgtgggtcttgggcatccaaaatagaatggattattataattgtttagtttttcaatttccaaactcctcatcagaaggttagaaatggagtcaagaggcctgaaaaggcgggcacggtggctcatgtcttgtaatctcagcactttgggaggcccaggcaggtggattacttgagcccaggagtttgaggccagcctgggcaacatggcaaaaccctgtttccacaaaagtacaaaaatattagctgagtgtggaggtgcactcttgtagtcccagctacttgcaaggctgagatgggaggatcacctgagcttgggaggttgaggctgcagtgaggtgtaattataccactgcaaatgcactccagtatgggtgacagagtgggaccttgtttccaaaaaaaaaaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccaggtataagctcattcacacttttaataaagtataaactacatttatattgcttctatgggacatataaggctatttatataatttttactttgtctttttttaataggaaaaattgtttctccaaagcattcgtttttatgtcttataatgcatgttgaactttttttatttttaccttgattaaatattggtcctgtaaatatatgttaacattcataaacttatattggacatctaaaatatacttctttctgagtgtctttgtttatggcttatgttgtgcttttagtggtttgggaacctggtcactatggaatggtggaatgatctttggctaaatgaaggatttgccaaatttatggagtttgtgtctgtcagtgtgacccatcctgaactgaaagttgtaagtagttatttatccttcacatttgaggttaatttgttgttttgttcaatattgctggaaaatattcactaatctttgattatagaacttataaaaatatttcactgataacttccttgacagtttagatatgaatcgtgttgcaaaaatgctagtgaactttcaagatataccacaaagacttatttacaaactcagttgtgaatctatgattgtttgtaaattgtccgattttatatttcttaatatcaaagaaatagaaataatggcagcctaaatgttccatttcattttcccaaccttcaggttgctcattgcagaattattaggtacagattactgatatctcaataggaccctacttgccaaatcaaatgagttatacttaaggtaactgcacatttgattgtataacaacctaggcttctggatcacaaatttattgctttggaactgctatatggtttattttttaaatcaccacatttaacttaagaaaatcacatatagcaaaattaaacttatgtaaaaatttttttatcctactccaatgattcttttcatttgtaaatatttattcctattttcatctgcctgtatacattatttaaaatatacatttgtgaatatttattactgcctattttcatctgcctgtgtacataattagaaagtacacatcaatattgcattataatcctaaatattttcttatgtttctacatgatctttagtaataaaaatgattatggatacatattgtcctgttgagctaatgtgctctaataaagctggttaaggttctccatttattttcattatgtttttaaaggtaagtatctttgctctaaaacagtacagacaatgattggaaatgttgaaattactatacagttaatttcttgttgtgttgctgtttggctataggcataattgtttcgtttttagattaatacgaaattttctttattctaaaggacttaagatgaacaaaatctataatgtttaactaaaatcattgtttcttgggtagcttttagaatatattaattctattttgtttcataaatattaggaaatatggaataggttgcccccaaaatgtgaagtatggacttcttgcctcagataaaatgtcccacctttgacattttttatctaaatgtaaatcataggtgatgttttcttttttctatctcaatagggagattatttctttggcaaatgttttgacgcaatggaggtagatgctttaaattcctcacaccctgtgtctacacctgtggaaaatcctgctcagatccgggagatgtttgatgatgtttcttatgataaggtaaaagtagattgagtataaggatacagtttagatactaaagttatacatactggggtggagaagttataggcaaggttgtggggttaaacccagattgaatgccttctctcttgacacgtgctggctggagtcaactcttttaggactaacttgcagtttggctcataaccctaaagattattttatgggaaattcttcatatattctttcttgggttgaaaattcatggcttacagaaactctgcttttattcatcattcaacaaataggtattgattgagcatcaactttgtactagacaaaaattcctgccctcgtgtagcttacttttcaaggccttcagcaatggttaatattgttgagacgcaaataattgtcttgcacagtgtgcttagtaacagagttgggaattgttgacaacagtttaatgattgggagattttatgtaaaatccagatttctagcttctcttggggaagaaaaaggaggatttggccactgtatgttctttgcagcataagctggagctaagttgttgttctctctttgtaagatcaaggctctgcttttccactttccctgccattcccaactgttctattgtcttctcaccgaggctgagagtgtgttgccagttaccattgtgcttggctgttgttttaccggtagcaaacagaaaagtctttcttgcttgcatgtttccattgaaagtccaggggaaaaagaatgtaaaagagcattcttcttatccttggactacttcccttatttatatgccctgtcatgtgccactggaggcatttgagtttgtgactcaccatccgtggtaatgggagtggaggggaaaagagccctttaccaaggaatacagggtgtctgggaagactcttgttccctttctcattgtgactccagctccatcagccctccatgctcaaggctgcctgggctccctggacatatccacttttccttccctggcatctacctctgcctccatctctagtgctccaccccttgttgtactggcctctccttagtcctgccctggaatggcagtgggagagccaggtagtagctcaaggtccaatgtttaatctgcaccattatccccactcacatgtgaacaaagggagttggcagatgatgctaatttgccccatcgggaggtctggctactgatagaaaataagggcctcagtgggctcagagcataagcaatcacattagacaaatctcctgcctaaacaggtccaggtttaacctgcttactctgtttcacaaattgccagacattaacagtgttcctgcagttgcgttttcaaagaaatgtgttttattgcaaaagaatatgtgatttcagatgagactgcaatgaaactatagataacaattatttctattatcttttcagggagcttgtattctgaatatgctaagggagtatcttagtgctgacgcatttaaaagtggtattgtacagtatctccagaagcatagctataaaaatacaaaaaacgaggacctgtgggatagtatggcaagtgtgagtatgtttttgaatatctctgcatttgggattgacaggcttatcatcttgttttgttttccctgcattatgttaatccctctgaggagaatcattgttttctatagaaataagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttcccttttaaagcagtggatttatgacatgtttctatagcagattacagctgcattgtagcagtcaaaaggatatgtcagtcatttacagagctctgcatttgtacaaagacaatggcactgagcattcttgaatacttgtcatgtgtcaggcacatgttaagcacttatatgtattatctcctttactcttcataataaacctgtgagctgggtactattactatccctatttttaaagttgagaacatgaaatacaaagacatctgattggtaaattgcagagcagagatctgaatttagatctaactcatgtttttaactgctaagctataaagtattcataacatcaagtcacaaaacagcctgagtctctgttcatctggacttgtgggatgttttcagaggaagctgagggtgagtctggagatacaacagaattttttgtttcttttttctttttatatgtttactttcttggcttttttgttcctagagactgctttattcagtagtttctagatttgtcctgtggcacattttatctttttactaattcttttttttttgagacagagtctcactctgttgcccaggctggagtgcagtggcgtgatctcggctcactgtagcctctgcctccccggttccagcgattctcttgcctcagcctcccaggtagccgggattacaggcacacgccactacacccggttaatttttgtattcttagtagagatgaggtttcaccatgttcgccaggctggtcttgaactcctgacctcaggtgatccacccaactcagactccgaaagtgctaggattacaggcatgagccaccgcgcccagcctttactacttcttaaatcatttcttaaaagcttttttagtatcaaaaaacagctccttttgagttcccactatttgttgagtgtgggtcatctctgtgttctcactttagaaacacaggctcttgactgaacattgtttccaccttgcttgtccaaaaccagcatagttaggtaggtattgaaaacctggcactttctctcccttctcttccttcattcattcacatgcctgctttgtgcccagtgttattgccagccccaaagtgtgcccggcagaactaggtatgctacctgtcctccagacacgtatgtgtagtggaggaaaatgacaagcaaacagctggtgctctaatggaggtgtgatggctggggacatcacactgagaaagggatcagaaagtgctcctaagaggggaggttggcaactggtagcggctgtttgagcataagctggtgttctctcttttcttagagttgggttaaatgggtgatgtgtctgcctttttgtgtacacaccagcattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtaatgctcctagagtaaaatttgttttgttgtctaggtaacatctgccttgtaggatggaaccttgcttttgaaataatgcccttaccactattgctaaaatatttcagctgcatctgtgtatcctatgaagttgacttatactccctgcccccatcttcccagtaggattaaggaggctttaaaccttggttattctcagtaaaggtgacgatgtaattactttaacattctcatattttgtaatttgatatgatggtaatttctggttactggcttgaaatcaactccaacctaagcaactgctactagattacaatagtgcctagcatttggttggagctgaggacaaaagaatttaggtgatttccgagaatgatgagagactcagttgtcttcttctgagttagatttggaacctgtttgtcagcttaatgctatagaagaatattattagaaacaagatgctgcaacttgattgaccctggatggataccgttaaaaaattcttttatcttgaaacaatttcagacttatagagaagttacaagaataacacaacaaattcctatatatcctttacctagatacatgttaactctttactcctttactttcttcacctccctctctctcttgctctctctctctctctatatatatatgtatatgtttgtgtggatatatgtgtgtgtgtatatatacatatatatgtgtatatatatacacacacatatatatatataatatatacacctccctcccccatcttcccaaaaggattaaggaggttttaaatcttgattaatcgatatccatctatctacatacatacctatatacatatgtctgtatgtatatacttggcatatgtttttctgaactgtttgacagtaaattggtgacatgattccccttcacacctaaatgtttcagcatagtattttctacaaaacaacatttatggccggtcacagtggctcatgcctttaataccaggactttgggaagccgaggcaggaggatcacctgaggttaggagttcgagaccagcctggccaacatggtgaaacaccatctctactaaaaatacaaaaattagccgggcatggtggcgggcgcctgtagtcccagctactcaggagggtgaggcaggagaatcgcttgtacccaggaggtggaggttgcagtgagccgagatcgcaccactgcactccagcctggacaacaagagcgaaactccatctcaaaacaaacaaacaaaaaacaagaacattcagttatataaccatagccacagtacaattatcaaaattgggaaataaactttatataatactattatctataaatcccattcaactttttccaattgtcctaaaaatatccttatagcaaaatagaaaataaattctgacttaggatttaatacaggatcacttattttatttagttgttgcatcattttggtctccatttttttctgaaacaactcttcagtcttttttgggcttctcgatattgacattttttgaagagtactggccagttattttatagaatgcctttcagtttggattttctgctgtttctccatgatcaggttcagcttacatatcattgacaggaatcccaaggaggtgatattgtgtccttcctaatatactattcaggaggcacatgagtcctgaagttaggcctctgagatgcaatcagccaatcactgtaaaaaggctttcagggttcacgtgagtccaaattcttagctctactcaaggagtccaagaaaaggaaatagtgcccgagctgacactccctacaaagctggaaaacagactggggatgttttgagagcttggctgtagcagttttggtactatcttgttctaaactaaccagtgcctggcacatgataggtgatttaataactgcttgttgaattgaatcaacaaatgaacaatccacctctcctttattttaggtacctgtggcatgttccattgacattcatcaccagcaaatccgacatggtccatcgatttttgctaaaaacaaaaacaggtaatttattttggaaactactagttaattcaaggaggaatgtgaaaatgtgtaggattaaagtgctgtttcttttgctatttatcttggttaaagcaaaagggatcagattgaaaatgctttctggtttcaaagaagaatggccaatatcttgccagatagagattatagctgaattatataatgctaaaaaggagggattaccagtgaacattcactattactttgttaacattactgggttatatcatatgtatggccagagatgtagttgccattcttttcatagatctgtaaatctcacaaaattgatgtctaaagctagtgttagcttttgtctattgagttgctgttttctggtttctgagagaaataagtgatgttttcaaatttttcagtattaaactcttctctaatttccttgcccaatcttggatgagaaaagctttcttcaggcaggggagcaaatggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcaggtaatacacgctgcacaaagtcgcggtttatttctgaaagcagctgttattgttcaaattcttgatttctaaagacaaaaatgattgattgataacaagaagttgaaaggtgttttcctttaagttcttctaacaacccaagattgcttttagtcttataattaacctcctgtctgtgactactaaggcacttgaaggaaggaatctgtatcttaatctttctcattaataattcagatcatactgaggcggaagtgtagataaccaggagatcaacatcctggcgaaactccttgccttgtccccgcggcatggtcccgcagcttcttctggccccgctataccggatcaggtttctcccaccactgggtctttataacagccttgaagtcttcttagaagactaagtgacacaggcccaagttgtttgcattacatttcttgggttaaagaagggatttttttttctttcctaaaccagatacctgaactttgcagcatctttatggaatatagctcataaaatgtagcccaaccaaatgatctctgagtgtgtgaagacagaattaacactaccctttttttttcctcccccatgacaatggtttttaaggaaatgctcccaaagcctaaaactcaaacttcttcaacatgtaggcagacctaaagtcctaagaggaagcatgcaggtgggaaggattatctctttctcctcatacccgtatccttctggcctaaattttgagtgccttctggttcttctcaccaccatactgggcctcctgaagtgagaaaaagcaatgggggagaaagttatgggttgcttacctagctgtttctttctgcctaaaaaattcccctctgtagaatatttctgcttgagccttagagggcttcttcttttttattttttaacttatataatatataccctaccactgaggtttttaacactaaccctctgtaatgaagggtttctaaggatatgcagtgtctttgaaatggagaagaaaatgtgtttcctccaggaactcatggttttgaccagatgatagtctgtttgaccaggcttcctaaagggtctttgatggaaatcccttgcttactctagaagttcaccactcaatccagtgtttcacagggatagatgctgatgtgcttcctttccggcttatccacgttagccctagacgttactgtttgagaaacttcctccctagtgtaaacatgccggatgttgtgttatatgtgatagaaaagagacttatatagtagttatctatctgtttgtttatttattttttggagatggagtctcactctgtcgcccaggctggagtgcagtggtgccatctcagctcaccgcctctgcctcccgggttcaagtgattctccggcctcagcctcccacataccaagtacctgccaccatgcctgcctattttatgtatttttagtagagacggggtttcaccatgttggccaggctggtcttgaactcccgacctcaggtgatccacctgccttggcctcctaaagtgctgggattacaggcatgagccaccgcgcccggccgtagttatctatttataagggacatttatatctgattgcttgttttgctagaagattaaaatatattttgaagcaaaaagttgacttcccggatttacttttaaaccactaaccacagtgtctcttggtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggtaaaagcctgaaataaaagttatgtaattattatttgtgttaaaaagtgttaatcattgtgtgtgtatgtgtgtgtgtgtgtgtgtgtgtgtgtgtgtgtgtgtatctttatatacatattaaggaaaagcaaataaatattagttcagtatttagatggactagcaagattttggttttatttggcactaaaaataggaatggcattcttagactctatttaatttgcatggatttgttatttccttcctttcacaaaccttttatttcattttcctttcctattacaatggctgacgttcagattttctgggactcttcatggtacttgaggaagaggcacaaaattgttatgcttggcaaaatgtcctgaagtcttgttgcataatttgctctcaaaatttagtcatgtaaactctctttgagtttgttttaaaagtcgcaattcatcctgactttaagtagatggatatcttataaaagtttgttatgaaaatatgaaagtcattcatcattatttattgtttttggcccttttataattaaacagtgctgcatgatttatacagtaaaagttagattatgctttaaaaattagcccccatcatctgagaccataatggattatattaacatgaaatgacctgtgacaatactggtccctgtttccctgtacaacgccctcaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgaggtcagtccttactaaataaccaatttgttgatgtgaagggcatcttttctgttttccatcattggtactaaacattagggaaaacaaaaagtttaagtgtctcccctgctgcccttttctggaaaataaattgctttttaagatttatctatgtatctcgtaactttaagaaatgctaggagggaacttctatgcataaaagtcaaatatctggggagttaggatggtatgggaataattctcattttgtataggcaatgcaaaatcttattaaacggtgacagccatgccatagagaaacacatgcattgtattttatagtagtttctttgggcttccaaattccctgacagggatgcatagtaattgctgacactgtctaagcaaggtaggattttaccgtatctggaaatccctattcttgctacacttcagtcctttttacatttggagcttaaaccccacccaggaaacatttatgccaacaacctacatgcttcagcttaaagaaatccaaacagtggtcctactgccgtcctgacttgtgatcatggtgtaaattttgaatatagtttgaatttcttttggcttgaaaggtgatcccctatggagtcacccagcatcattaaagtatttaaatatgtaggtatttataaaaatggcatttcacatttttgagaaggctacttaaaacctaattttagatatttttctcttgccttttttttataaagtgtaactaggccaggcgcggtggctcacgcctgtaatcccagcactttgggaggctgaggtgggtggatcacgaggtcaggggatcaagaccatcctggctaagacggtgaaaccccgtctctactaaaatacaaaaaatgagccgggcatggtggcgggcgcctgtagtcccagctactcgggaggctgaggtaggagaatggcgtgaacccgggagggcggagcttgcaggaaccgatatcgagccacggcactccagcctgggtgacagagcaagactccgtcctaaaaaaaaaaaaaaaaaaaattgtaactgaaggaaatcagtagtttttgtttatatttccaggcatgcttctctgatcatggggaaagttcagcagttcatagttagtcaccattatgcctctaaacatacttactgcacctcagattctcaccgagtgtgttcctttctatagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggtgagtccgtcattcattcatgttcatgtggccaagggaaattagattagattagatcattctggcatctatttttgttttcttggccaggaattgcctatcctgctgggaacatactgcaagtcagcacacatctaatgagaaaggcaaataattagggagaaccaggtgttaggaaaaatatttaaaggtgtatacatttgtgcatctttaaaatgacaacatattaaaaatatttactagagctactcttccttaactattcttttgagcaaatgagagggtatatgagaatgggtgttatgaacactatataaatgttagtttttattatgtagctatagtgggtttatcaggattgtggttacccatttatctttttaacctttgttactggcagacttttttttcttttacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaaaaaaaaatctatatatatatttttaaacataaatgaaaattagctaattaatatggggtagacaaaatactttgagggtgtggtgagttagaaatggattgtcatttagaagttatttttggatgctatggtgttgacagcagcataaatcagttgcaattaaactagtgaaaactgtgcctcttctcagacacgttaagaggtcttagctctgccagtaaaaaccttaggacttgaagaaaattacttgagacaattagtccttgtttaaggatgttaaaagtgggcactgaggtataaatgactgaagtggtcatccagctgttgctaaagaggcaggtccggaatctaggttctttataaaccatccaagttcatggttccctgtcacttattatgtaaccatctaccttcagaaagaatttcaggcagctttaagatccatgtataaaagaaatgttaaaatgaaggacaaaaagatacataatggacaggtgataaccatgtgagggacttatggctgaggataattctcgcaattgtcccctgaatttatcacagacattcctggaagtcaaggaaaaatgaggaatcagtatgagttattctcattgtctggtaaaagagaacatgaagcatacacattttctacaaaagcagacttttcttcagtcctaaactcgaggactttgatgtgtgggccattgagttctgtggtgtcccttctataataaggtttcctatagtaaagttgtggaacaaattttacaaggctcttaaactgtggtacatttagataaaagctgagaggctaatattaatttttttaggagtggttccattgtgtagtctggttacactattttctagcttgagatggggagagagctttggaaatgaaaaagaatgaagggttgttacagtctcgtagcttttttccagttttcagtagcctcatccaggcttgtaaaattaacttgcatataataattcaagcttgaactccagcgaggtctagagcagagatactctgtctgatgactgaagagatgtccaaagccttgaccagaaaggtagtcatctatagacaagatctatagcaacaaagcatttcattcattcacttgtattctcattaattcattcaagacatatatgccacacatggttttaggttatggggctgtaacagtgaacagacagacaaaacctttgctgtcacggagctgaaatttctgctgtgggaatcagacaattacagacaaatcaaccaatgtcaagtagttacatgctctgaagatgaataaggcaaggagagtgattgggatagagggttggtgctgttttataggatgattaggagacatttgagaagatatcgaaggaaatgccaacatctagaggagtattgtgtgcagaggaaatatcaggtgcgaagatcctgaagcagggcatgaaaagtaaagagcccgagatgttatcataatggagagcaaactacggacatataaaatacgggagtcatcctgaatcctttcttccccagacatctaactacgcaagtcctgccggtcttccctcagcacatgcactggatcttgcgcacttctctctgctcttacccccattcaatcctttctcatctcttgccttgcctattgcaatagtgtcctaactggcctcccccttgccactttgccaatagcaaaacattttccacattgaagactgcaagtcagcccataactgaccctggcttcttgaaaccctgcctattgttcttgcagtaaattccaaatccctccttcccatgtgtccatgaccttgaagacctggcttctgaggacctctctggtgccaattcccacaggcgctcctggcttactctctcataacactgtagccactcagcctccttctgctcctgggctaccacatgtttctcctgtctttaagcctctgcactttttattctctctgcctggcttgcccattccccaacttttcactagaaaggggcattttatctttgagaggtctcggctcagatcaccttccccaaaaccatgctgttcaatgcaggccacatctcctcagttactagcatacccctggcatattttcttcatagcagtttatttacagtaatcatatttactgcttgtataccccaaaagactgtaagctccatgaggggaggatgcttgcctgattcactgctgcatcctcagtgtctagcacagtaattacagcagagggatgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaactttatgtggattttatcttgagacaacaatacatgaattgtagattaggataaaaaaaatggcaaggtttgggtcttaccgccataacttgctaagaatcccattccccacagtgtttctataataacatacaaggccaggcccatggagaaagacagcacttacgtggtggaaactgttttgcttggcaaagaaaagactctgcacattctgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgaagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttccataaagccagacgctatacagtgcaaaggctaatgtggcaatagctctaaagacacagttgctgctcaggttttatgtatagataatagaaagcacagtttactaacacagtaaaccaacagagttcaagtcagatgagtaccctaagaattaattagattttatttcttatgctcgaaatttgctacacaaggacttatctaacctttattttgctctgttgctgacttgattcaagtctcagtgtgttctgtgctgactgtaagatgcagaagtcctcacacctggcaaagaagagttcaaactgaaaaggggtttggtgcttcctggtttgtccaggttacctgttattaatttattattagcagcccaagaggagatatgtgcccaatgtacaatatcttatgtttgacttataaacattatcccaaagcaacatcaaatacagttcaaaagcccaagaggaaagggggtaataagaaatcagaacactgaagaatgtttaaaacattgttttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccagctgaagattttacatgcagataccttaaaaatttcaaataaaaaatgcagtgaatcatttaatatgtaattttcttgttacagacatagtaaatataccacttagcaaaagcattgtataacagacagaaggaatttcctataagtaaacatgaaagtggattaatagaattttttttaattttgggaaaaatgttagagcagttctacctaatatagctccttttttcctaggaaataaacatggatcatggtgagagagctgaacccgatttaacctatactttgatttcttttaggctttggtcagtaagtgcttgtatgcttttaaggcttacattaagccctctcctttctgaagattaagataagggcccagttctgaagatctcagaaatcccttcaatctgtccagtttcttcagcaattataaattagaatcaaacacagtactttactttccaaaataatgacaaataaaaatggccaatcttttcctttgcccttgttcccaaaaccctgtaatttccaccagactctaaagggtacttctccccaccccaccatgtattggtattctggggaatgccaatgtcttcaggacatttcgctaagttgtaacatgctaattttgctttgccacaataacctgcagtaatgagcatttggatttcaaagattcaactagcctcagatggtcattctaagtgcctggcctaatatttttaaaagcttttaattataagattaaggtttttaaacatttcaatagcaaactcatcccatttagtgctttcagagaatgaccaattactctgtagatcttgcagtatgcatttcatgccaatactgtaaagtgagcatgaattactcaagaggtggacttcacttctctcatctataacacataaattggcagaagatacagttgtcttcatttacaaataaacacccaacttaccagataccttaacttgtatttctttagtcatcttttggcttggaagtttcctctgttgtctaaaagggaaagcaaaaccatccgtgagctttcttttctgtattaagtatgaggagatggccttctcagaattaggggacaaaagatggcagtcagtggggaaaaataagatggtcctttcagtttctcttcttcatctggccacaatattgtgagttcttcctcctcaagcttataagctaaaaataaccttaagtgatcctgatcctaaatgtatcactctcagctttatttttttaaggctagggtaggttataaaatatgcataggtgttcttaaatggcaatgtttcattctgtggtgatccttcctttcctgtacatagggtcatggctgtccagtaaatccactcatcataaagggttattatgctttctattatttgttaaagggctgattaagtacttcgtataactgaaattaaataataggcaaataagtatttaaactgagatataatggcataactgccaattatcaatgctgtttcctatatcccttaagggaatctactacaggaagattttaatatattgttttaaaagctttggtgtaactggactattgtctttaaagctacacctttaactcctccttatagccaggggatcatagtaataatcatttaaatcatatgttcttggaattggaagggacctagaagttgtctaatccaattttcatttctcatcacagcttgagtaattttaataataggaagtttccaacttccatgttctaaaatctatataaaccacatactatggtggtattttaattagggcaagaaagacaggcaaaacacaggcaaattgggttgtgtcaagaacattcatttaggattttaaagcaccagttacttaaaaatatatgtatttatacaaattcaattactttaccaagcgatgctatgggatagatagtactttaagaaattttattctaaatagattccagtaggaaactaaatgactgaaatgataaaccctactctgtgtaactgctaaactaatttgtagtatatttactgctccatttacctttgctgaatccttcgctttacctccattcttaggtgctttggagctggaagcagccttcttgcacttatcctaaagcaaaggaaatgtaatgaggctatggctatcaccaatccatctagcaattaactaggctgcagttaaattaatccagaccattctgagatctccaatttaattaaataatggaagactttgggtgttttttcatgattttttttgaacaacggtgtcagagaattgtttaaagcaggagggaaaaaggatagaaataaggagggaaatgtgggtgacattgatgctctaattcccgtggtgcctgactcacccagaccttattttgctaatcaaaacagagcttgtcaatagataataaatgtcggcaagggtgtggagaaaagggaaccctagtacactgtcagtggggatgtagattggtatgggctatgatggaaaacagtatataggttcctaaagaaattaaaagtagaactactgtatgacccagtaatccctcttctgggtatatacccaaaggagatgaaattatcaccttataaagatatctgcactcccatattcactgcaacattactcacaatagccaagatatggaacaacctagttgttgatgaatggataaagaaaatgtcatgtatatatacataatggaatattattcagccttaaaaaacgatatcctactatttgtcacaacatggatggacctggaagaccttatactagatgatataagccagacacagaaagaaaagtgatttcacttatatgtagaatatatataaaagaaaaagctcaaaaacacagagaataaaacatggcgaccatggtagggaacaggaggaggaaacagagatataggtcaaaggatacaaaatagcagatatgcagaatgaacaagtgtagagagttaatgtataacatgaggactaaggttaataaaattgtattagggattttgttaactaagtagattttagctgcttttgtcacaaaaagtagttgtgtgagaatgatagatatgtaaatctgcttccctacagtaaccattttattatttctatgcatcccaaactaccatgttgtaaacctcaaatatacacaataaaatgtatttaaaaaacaaaatagagcttgtctcgatcaggactggcttttgtgtaccaaaaggcaaaaaaaaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatagaaaaaaaaggaaatccacaaaataatactgttttgggggcagtggaattataggcattttttcttttcttcattttcaggttctctatatcatcgtttgattcattctacagtttaaaaattgtaagggccaggcgcagtggctcaagcctgtaatcccagtactttgggaggtagaggttggcagatcacttgagcccaagagctcgagaccagcctggcaacatggcgaaaccccctctctacaaaaaaatacaaaaattagctgggtgtggtggtgcacgcctgtagtcccagctactcaggaagctaaggtaggaggattgcttgagcccaggaagcagagatcgcagtaagctgagatcacaccactgcactccagcctgggctatagagtaagaccctgttacaagacagaccgatagatagatcaatcaataaataaaacttatatgtatgtacacatacacacacacacatttcaaagagtgaaatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtggaattgctatcttgaggaatactgaatgcaagcaaggagaattggttcctgtaataggagaccctgaagctgacactgctatttaaaccaggaatcatcttactcaccaaaatgaatcagtacagaaagagaagggtgtaatttggtcttccttgtttcttatttgatgaacaggcatggaaagggttatttatcatctaattgactcaaaaattagaaactaaataggaaagaggtgggggacaggcctggttgacctacgaaagactggcctctatcatgtgggagacaaaaggccagggactttttggcagagaaacaggatttgtgattgggaatattgctttgcctgtcttcacttgcaatagtgctgatgatgatgcaggagaagatagggagaccccaggtcttggagctgccttattaattttccctattaattatcccaacaccagctccttttctgctctccttaaacagagattgcttcctttgaaatcctatcaccttagtcatttttatagccttttcttgaaagagagaatcacatttcttggatcactcttaagcatctgtgagtgactgaacagtattcaaccctgtttataccacagagcctagcatatgcatatataatgatattggctcaaataaatatttacctgctggtcggctttggtgacacattagaagcagtcagtcatggtatgttttatgctattgtaaaggagtatagctactatttatttcaagggaggtttgaatttaaagatcttggtagcataaatccgatctagcaatttgcctcagtttacctgtccattatcatccaggagatgtctgtattcaggtgggatagtgtcatctctttctccaagcttgtctctatgttcagctttagctttttcctatatcaacagtgagcagatagaattaatattcatttcctctttcacttagaaaatacattgtcaaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggaaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctctgctggtatctctgtcacagattcagtgaccttcccctccagtggagtacagattgatttttctatttcattataatttcatgtttaaaatataggttaagttcacatcaatattcctatgacaatgacagagtcaagacccaaggattaaaatttcactattagtgaattttttttttttttttttttttttttacctttactttatcttccattggtttgttctcatctgggtcaggctgcctttgtcctagactgtcagagagtttatccaaggcatcatcgaggtctttgtcactctgctgaaaagtaaataatgctgaattagtcactcattagccaaactgtatcagaggcaaattagcccaggaactccatcttttcaggagggaacctgtttccttggaagaaaaagacatctggggctggggcaggggagtagacagggtcagagaagagaagcctaggaatggaagatcaggagaagagcggcagtatctgtcaccctactggggttggagggccagcaccttccacccaaccctgcccatctcttggtgaagatcccaccaggttaaggaggtcttagtggcagcctcaggagccatatccagtgggtgacctggaggtcacataaagggtccaaaagcaaatgaaccaatcatgtgtgcctttcatttagaaattaaacaccattagaaaactggatatgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggacaacaatatcactgtaactaagatagcttatttcctctaacatttatttactgtatgattcaggcagcttatttaacccctttcagcttcagtttccttggccgtgaaatgtgaataatagtagtacttatactcctaagttgctgagaaaagtaaatgattgaaaaggcatttaaaacaatactagttgtatgttaggacccaacaaatggtaaattattattagtattattatagcaaaatccatatttttcaacacattgcattcaaaattccacctctaaatgaattcaattaaaatgtgtttaatatctacattgtataagacaccatgctgaactctgtccaatactgtatagaactttccagttgattttcaaaatgttttcacatacactatccagttttatttgatgcccacaatggttctcagtgaactaagcaggctttttttttttgaggtaaaaagctcagggaagctaagtcagttgcttgaaaacaaattgttaaaaagtgaatagaacccaggtcttgggactgataaagcttttccctgtcatgcttagtcacatccatgatcttctattttctttgaagcagttttcctgttggagtgattttattacacagatctttgaaatcatgtcttcaaatgctttcagtgtatgtaacactgttagtaacaatctaataatcacagcaaagaaagctcccgtgaattatcatggtttatttgactcttcgatttcctaatatttttatctaaataaagctttataccttgttttagtgacatcttcaaataaaatgttaactaaaaacaagcctctctgatgggaaatgtgatcagagaagtgtcattgtaaaacctacttcttaaaggcaaaaaagtttttgattgcaaatgtttactgatagccttcatcagggcagaatctctggcctgaatattaagaactgaagtgtaaacggcagcctaggctattaatgattcttcctttctgttgcatggggactttcttcattgtgggtgtgtttacatacacacatgcacatgcacatgcacatacacacacacggggcattttactggttttaagtgctttattataatccaggattatagctgctaatggtagagctgcccggggccaggtctgggctttgtcatttgtgcctctggatattttcagatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 6 - RNA, 5495 nt, Homo sapiens
  source 1..5495: mol_type = mRNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 7 - RNA, 5495 nt, Homo sapiens
  source 1..5495: mol_type = mRNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 8 - RNA, 5495 nt, Homo sapiens
  source 1..5495: mol_type = mRNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccaacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 9 - DNA, 5495 bp, Homo sapiens
  source 1..5495: mol_type = other DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 10 - DNA, 5495 bp, Homo sapiens
  source 1..5495: mol_type = other DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 11 - DNA, 5495 bp, Homo sapiens
  source 1..5495: mol_type = other DNA
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccaacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 12 - protein, 948 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 13 - protein, 948 aa, Homo sapiens [sequence omitted]

SEQ ID NO: 14 - protein, 948 aa, Homo sapiens [sequence omitted]

SEQ ID NO: 15 - DNA, 20 bp, synthetic construct
  misc_feature 1..20: note = Synthetic sequence; gRNA Recognition Sequence
  source 1..20: mol_type = other DNA
gtgcaatttgctcctgacgg

SEQ ID NO: 16 - DNA, 20 bp, synthetic construct
  misc_feature 1..20: note = Synthetic sequence; gRNA Recognition Sequence
  source 1..20: mol_type = other DNA
cacttgccatactatcccac

SEQ ID NO: 17 - DNA, 20 bp, synthetic construct
  misc_feature 1..20: note = Synthetic sequence; gRNA Recognition Sequence
  source 1..20: mol_type = other DNA
tgtacgggagcccgacaagg

SEQ ID NO: 18 - DNA, 20 bp, synthetic construct
  misc_feature 1..20: note = Synthetic sequence; gRNA Recognition Sequence
  source 1..20: mol_type = other DNA
gaagatgagcacctatctgg

SEQ ID NO: 19 - DNA, 20 bp, synthetic construct
  misc_feature 1..20: note = Synthetic sequence; gRNA Recognition Sequence
  source 1..20: mol_type = other DNA
ccctaataaccatcacagtg

SEQ ID NO: 20 - DNA, 20 bp, synthetic construct
  misc_feature 1..20: note = Synthetic sequence; gRNA Recognition Sequence
  source 1..20: mol_type = other DNA
aaggccattctagctgcagt

SEQ ID NO: 21 - DNA, 20 bp, synthetic construct
  misc_feature 1..20: note = Synthetic sequence; gRNA Recognition Sequence
  source 1..20: mol_type = other DNA
agattatgcactggatgctg

SEQ ID NO: 22 - DNA, 20 bp, synthetic construct
  misc_feature 1..20: note = Synthetic sequence; gRNA Recognition Sequence
  source 1..20: mol_type = other DNA
caaaaatcgatggaccatgt

SEQ ID NO: 23 - DNA, 20 bp, synthetic construct
  misc_feature 1..20: note = Synthetic sequence; gRNA Recognition Sequence
  source 1..20: mol_type = other DNA
tttccacaggtgtagacaca

SEQ ID NO: 24 - DNA, 20 bp, synthetic construct
  misc_feature 1..20: note = Synthetic sequence; gRNA Recognition Sequence
  source 1..20: mol_type = other DNA
tgaaaaccatgatgaacact

SEQ ID NO: 25 - DNA, 20 bp, synthetic construct
  misc_feature 1..20: note = Synthetic sequence; gRNA Recognition Sequence
  source 1..20: mol_type = other DNA
catagcaccagactgaaagt

SEQ ID NO: 26 - DNA, 20 bp, synthetic construct
  misc_feature 1..20: note = Synthetic sequence; gRNA Recognition Sequence
  source 1..20: mol_type = other DNA
tcaagagatcataatgaact

SEQ ID NO: 27 - DNA, 20 bp, synthetic construct
  misc_feature 1..20: note = Synthetic sequence; gRNA Recognition Sequence
  source 1..20: mol_type = other DNA
ttgtattctgaatatgctaa

SEQ ID NO: 28 - DNA, 20 bp, synthetic construct
  misc_feature 1..20: note = Synthetic sequence; gRNA Recognition Sequence
  source 1..20: mol_type = other DNA
gaagcaagagcactacatga

SEQ ID NO: 29 - DNA, 20 bp, synthetic construct
  misc_feature 1..20: note = Synthetic sequence; gRNA Recognition Sequence
  source 1..20: mol_type = other DNA
acctggtcactatggaatgg

SEQ ID NO: 30 - DNA, 20 bp, synthetic construct
  misc_feature 1..20: note = Synthetic sequence; gRNA Recognition Sequence
  source 1..20: mol_type = other DNA
caaaagcacctacagaacca

SEQ ID NO: 31 - DNA, 20 bp, synthetic construct
  misc_feature 1..20: note = Synthetic sequence; gRNA Recognition Sequence
  source 1..20: mol_type = other DNA
ctgtgtacgggagcccgaca

SEQ ID NO: 32 - DNA, 20 bp, synthetic construct
  misc_feature 1..20: note = Synthetic sequence; gRNA Recognition Sequence
  source 1..20: mol_type = other DNA
atacaaaaaacgaggacctg

SEQ ID NO: 33 - DNA, 20 bp, synthetic construct
  misc_feature 1..20: note = Synthetic sequence; gRNA Recognition Sequence
  source 1..20: mol_type = other DNA
tccaccattccatagtgacc

SEQ ID NO: 34 - DNA, 20 bp, synthetic construct
  misc_feature 1..20: note = Synthetic sequence; gRNA Recognition Sequence
  source 1..20: mol_type = other DNA
ctattacattgtgcattacg

SEQ ID NO: 35 - RNA, 20 nt, synthetic construct
  misc_feature 1..20: note = Antisense Sequence
  source 1..20: mol_type = other RNA
cgcctttctgaacgcggatc

SEQ ID NO: 36 - RNA, 20 nt, synthetic construct
  misc_feature 1..20: note = Antisense Sequence
  source 1..20: mol_type = other RNA
acgcctttctgaacgcggat

SEQ ID NO: 37 - RNA, 20 nt, synthetic construct
  misc_feature 1..20: note = Antisense Sequence
  source 1..20: mol_type = other RNA
cacgcctttctgaacgcgga

SEQ ID NO: 38 - RNA, 20 nt, synthetic construct
  misc_feature 1..20: note = Antisense Sequence
  source 1..20: mol_type = other RNA
tgcacgcctttctgaacgcg

SEQ ID NO: 39 - RNA, 20 nt, synthetic construct
  misc_feature 1..20: note = Antisense Sequence
  source 1..20: mol_type = other RNA
gatcaggcgtaggaagtgca

SEQ ID NO: 40 - RNA, 20 nt, synthetic construct
  misc_feature 1..20: note = Antisense Sequence
  source 1..20: mol_type = other RNA
ggatcaggcgtaggaagtgc

SEQ ID NO: 41 - RNA, 20 nt, synthetic construct
  misc_feature 1..20: note = Antisense Sequence
  source 1..20: mol_type = other RNA
gggatcaggcgtaggaagtg

SEQ ID NO: 42 - RNA, 20 nt, synthetic construct
  misc_feature 1..20: note = Antisense Sequence
  source 1..20: mol_type = other RNA
gaagctgcgaggttgcgatg

SEQ ID NO: 43 - RNA, 20 nt, synthetic construct
  misc_feature 1..20: note = Antisense Sequence
  source 1..20: mol_type = other RNA
ggaagctgcgaggttgcgat

SEQ ID NO: 44 - RNA, 20 nt, synthetic construct
  misc_feature 1..20: note = Antisense Sequence
  source 1..20: mol_type = other RNA
gggaattggtaaatgagcgc

SEQ ID NO: 45 - RNA, 20 nt, synthetic construct
  misc_feature 1..20: note = Antisense Sequence
  source 1..20: mol_type = other RNA
agggaattggtaaatgagcg

SEQ ID NO: 46 - RNA, 20 nt, synthetic construct
  misc_feature 1..20: note = Antisense Sequence
  source 1..20: mol_type = other RNA
gaagggaattggtaaatgag

SEQ ID NO: 47 - RNA, 20 nt, synthetic construct
  misc_feature 1..20: note = Antisense Sequence
  source 1..20: mol_type = other RNA
ggaagggaattggtaaatga

SEQ ID NO: 48 - RNA, 20 nt, synthetic construct
  misc_feature 1..20: note = Antisense Sequence
  source 1..20: mol_type = other RNA
ccaggaagggaattggtaaa

SEQ ID NO: 49 - RNA, 20 nt, synthetic construct
  misc_feature 1..20: note = Antisense Sequence
  source 1..20: mol_type = other RNA
cccaggaagggaattggtaa

SEQ ID NO: 50 - RNA, 20 nt, synthetic construct
  misc_feature 1..20: note = Antisense Sequence
  source 1..20: mol_type = other RNA
aagccgcaactcccaggaag

SEQ ID NO: 51 - RNA, 20 nt, synthetic construct
  misc_feature 1..20: note = Antisense Sequence
  source 1..20: mol_type = other RNA
gaagccgcaactcccaggaa

SEQ ID NO: 52 - RNA, 20 nt, synthetic construct
  misc_feature 1..20: note = Antisense Sequence
  source 1..20: mol_type = other RNA
aaagggtaaacgggagtggg

SEQ ID NO: 53 - RNA, 20 nt, synthetic construct
  misc_feature 1..20: note = Antisense Sequence
  source 1..20: mol_type = other RNA
gaaagggtaaacgggagtgg

SEQ ID NO: 54 - RNA, 20 nt, synthetic construct
  misc_feature 1..20: note = Antisense Sequence
  source 1..20: mol_type = other RNA
ggaaagggtaaacgggagtg

SEQ ID NO: 55 - RNA, 20 nt, synthetic construct
  misc_feature 1..20: note = Antisense Sequence
  source 1..20: mol_type = other RNA
gaaagtgaaagtggagcccg

SEQ ID NO: 56 - RNA, 20 nt, synthetic construct
  misc_feature 1..20: note = Antisense Sequence
  source 1..20: mol_type = other RNA
ggaccgaaagtgaaagtgga

SEQ ID NO: 57 - RNA, 20 nt, synthetic construct
  misc_feature 1..20: note = Antisense Sequence
  source 1..20: mol_type = other RNA
aggaccgaaagtgaaagtgg

SEQ ID NO: 58 - RNA, 20 nt, synthetic construct
  misc_feature 1..20: note = Antisense Sequence
  source 1..20: mol_type = other RNA
caggaccgaaagtgaaagtg

SEQ ID NO: 59 - RNA, 20 nt, synthetic construct
  misc_feature 1..20: note = Antisense Sequence
  source 1..20: mol_type = other RNA
ccaggaccgaaagtgaaagt

SEQ ID NO: 60 - RNA, 20 nt, synthetic construct
  misc_feature 1..20: note = Antisense Sequence
  source 1..20: mol_type = other RNA
tcttgctctacctacctggg

SEQ ID NO: 61 - RNA, 20 nt, synthetic construct
  misc_feature 1..20: note = Antisense Sequence
  source 1..20: mol_type = other RNA
ttcttgctctacctacctgg

SEQ ID NO: 62 - RNA, 20 nt, synthetic construct
  misc_feature 1..20: note = Antisense Sequence
  source 1..20: mol_type = other RNA
cttcttgctctacctacctg

SEQ ID NO: 63 - RNA, 20 nt, synthetic construct
  misc_feature 1..20: note = Antisense Sequence
  source 1..20: mol_type = other RNA
caccatcttcttgctctacc

SEQ ID NO: 64 - RNA, 20 nt, synthetic construct
  misc_feature 1..20: note = Antisense Sequence
  source 1..20: mol_type = other RNA
acaccatcttcttgctctac

SEQ ID NO: 65 - RNA, 20 nt, synthetic construct
  misc_feature 1..20: note = Antisense Sequence
  source 1..20: mol_type = other RNA
aacaccatcttcttgctcta

SEQ ID NO: 66 - RNA, 20 nt, synthetic construct
  misc_feature 1..20: note = Antisense Sequence
  source 1..20: mol_type = other RNA
aaacaccatcttcttgctct

SEQ ID NO: 67 - RNA, 20 nt, synthetic construct
  misc_feature 1..20: note = Antisense Sequence
  source 1..20: mol_type = other RNA
gttaagagagccaacagtga

SEQ ID NO: 68 - RNA, 20 nt, synthetic construct
  misc_feature 1..20: note = Antisense Sequence
  source 1..20: mol_type = other RNA
agttaagagagccaacagtg

SEQ ID NO: 69 - RNA, 20 nt, synthetic construct
  misc_feature 1..20: note = Antisense Sequence
  source 1..20: mol_type = other RNA
acacagttaagagagccaac

SEQ ID NO: 70 - RNA, 20 nt, synthetic construct
  misc_feature 1..20: note = Antisense Sequence
  source 1..20: mol_type = other RNA
tggacacagttaagagagcc

SEQ ID NO: 71 - RNA, 20 nt, synthetic construct
  misc_feature 1..20: note = Antisense Sequence
  source 1..20: mol_type = other RNA
agtggacacagttaagagag

SEQ ID NO: 72 - RNA, 20 nt, synthetic construct
  misc_feature 1..20: note = Antisense Sequence
  source 1..20: mol_type = other RNA
tgaaggagtggacacagtta

SEQ ID NO: 73 - RNA, 20 nt, synthetic construct
  misc_feature 1..20: note = Antisense Sequence
  source 1..20: mol_type = other RNA
atgaaggagtggacacagtt

SEQ ID NO: 74 - RNA, 20 nt, synthetic construct
  misc_feature 1..20: note = Antisense Sequence
  source 1..20: mol_type = other RNA
accatgaaggagtggacaca

SEQ ID NO: 75 - RNA, 20 nt, synthetic construct
  misc_feature 1..20: note = Antisense Sequence
  source 1..20: mol_type = other RNA
acaccatgaaggagtggaca

SEQ ID NO: 76 - RNA, 20 nt, synthetic construct
  misc_feature 1..20: note = Antisense Sequence
  source 1..20: mol_type = other RNA
gacaccatgaaggagtggac

SEQ ID NO: 77 - RNA, 20 nt, synthetic construct
  misc_feature 1..20: note = Antisense Sequence
  source 1..20: mol_type = other RNA
tgacaccatgaaggagtgga

SEQ ID NO: 78 - RNA, 20 nt, synthetic construct
  misc_feature 1..20: note = Antisense Sequence
  source 1..20: mol_type = other RNA
ctgacaccatgaaggagtgg

SEQ ID NO: 79 - RNA, 20 nt, synthetic construct
  misc_feature 1..20: note = Antisense Sequence
  source 1..20: mol_type = other RNA
ctctgacaccatgaaggagt

SEQ ID NO: 80 - RNA, 20 nt, synthetic construct
  misc_feature 1..20: note = Antisense Sequence
  source 1..20: mol_type = other RNA
gctctgacaccatgaaggag

SEQ ID NO: 81 - RNA, 20 nt, synthetic construct
  misc_feature 1..20: note = Antisense Sequence
  source 1..20: mol_type = other RNA
tgctctgacaccatgaagga

SEQ ID NO: 82 - RNA, 20 nt, synthetic construct
  misc_feature 1..20: note = Antisense Sequence
  source 1..20: mol_type = other RNA
gtgctctgacaccatgaagg

SEQ ID NO: 83 - RNA, 20 nt, synthetic construct
  misc_feature 1..20: note = Antisense Sequence
  source 1..20: mol_type = other RNA
ggagatgcttcagtgctctg

SEQ ID NO: 84 - RNA, 20 nt, synthetic construct
  misc_feature 1..20: note = Antisense Sequence
  source 1..20: mol_type = other RNA
tggagatgcttcagtgctct

SEQ ID NO: 85 - RNA, 20 nt, synthetic construct
  misc_feature 1..20: note = Antisense Sequence
  source 1..20: mol_type = other RNA
gttttggagatgcttcagtg

SEQ ID NO: 86 - RNA, 20 nt, synthetic construct
  misc_feature 1..20: note = Antisense Sequence
  source 1..20: mol_type = other RNA
tacgttttggagatgcttca

SEQ ID NO: 87 - RNA, 20 nt, synthetic construct
  misc_feature 1..20: note = Antisense Sequence
  source 1..20: mol_type = other RNA
ctacgttttggagatgcttc

SEQ ID NO: 88 - RNA, 20 nt, synthetic construct
  misc_feature 1..20: note = Antisense Sequence
  source 1..20: mol_type = other RNA
actacgttttggagatgctt

SEQ ID NO: 89 - RNA, 20 nt, synthetic construct
  misc_feature 1..20: note = Antisense Sequence
  source 1..20: mol_type = other RNA
cactacgttttggagatgct

SEQ ID NO: 90 - RNA, 20 nt, synthetic construct
  misc_feature 1..20: note = Antisense Sequence
  source 1..20: mol_type = other RNA
atcactacgttttggagatg

SEQ ID NO: 91 - RNA, 20 nt, synthetic construct
  misc_feature 1..20: note = Antisense Sequence
  source 1..20: mol_type = other RNA
catcactacgttttggagat

SEQ ID NO: 92 - RNA, 20 nt, synthetic construct
  misc_feature 1..20: note = Antisense Sequence
  source 1..20: mol_type = other RNA
ccatcactacgttttggaga

SEQ ID NO: 93 - RNA, 20 nt, synthetic construct
  misc_feature 1..20: note = Antisense Sequence
  source 1..20: mol_type = other RNA
cccatcactacgttttggag

SEQ ID NO: 94 - RNA, 20 nt, synthetic construct
  misc_feature 1..20: note = Antisense Sequence
  source 1..20: mol_type = other RNA
tcccatcactacgttttgga

SEQ ID NO: 95 - RNA, 20 nt, synthetic construct
  misc_feature 1..20: note = Antisense Sequence
  source 1..20: mol_type = other RNA
gtcccatcactacgttttgg

SEQ ID NO: 96 - RNA, 20 nt, synthetic construct
  misc_feature 1..20: note = Antisense Sequence
  source 1..20: mol_type = other RNA
tgtcccatcactacgttttg

SEQ ID NO: 97 - RNA, 20 nt, synthetic construct
  misc_feature 1..20: note = Antisense Sequence
  source 1..20: mol_type = other RNA
gtgtcccatcactacgtttt

SEQ ID NO: 98 - RNA, 20 nt, synthetic construct
  misc_feature 1..20: note = Antisense Sequence
  source 1..20: mol_type = other RNA
ggtgtcccatcactacgttt

SEQ ID NO: 99 - RNA, 20 nt, synthetic construct
  misc_feature 1..20: note = Antisense Sequence
  source 1..20: mol_type = other RNA
tggtgtcccatcactacgtt

SEQ ID NO: 100 - RNA, 20 nt, synthetic construct
  misc_feature 1..20: note = Antisense Sequence
  source 1..20: mol_type = other RNA
attccaaggaaatggtgtcc

SEQ ID NO: 101 - RNA, 20 nt, synthetic construct
  misc_feature 1..20: note = Antisense Sequence
  source 1..20: mol_type = other RNA
tattccaaggaaatggtgtc

SEQ ID NO: 102 - RNA, 20 nt, synthetic construct
  misc_feature 1..20: note = Antisense Sequence
  source 1..20: mol_type = other RNA
gatcataatgaactgggatg

SEQ ID NO: 103 - RNA, 20 nt, synthetic construct
  misc_feature 1..20: note = Antisense Sequence
  source 1..20: mol_type = other RNA
gagatcataatgaactggga

SEQ ID NO: 104 - RNA, 20 nt, synthetic construct
  misc_feature 1..20: note = Antisense Sequence
  source 1..20: mol_type = other RNA
agagatcataatgaactggg

SEQ ID NO: 105 - RNA, 20 nt, synthetic construct
  misc_feature 1..20: note = Antisense Sequence
  source 1..20: mol_type = other RNA
gtcagcgtggtaaggtttgc

SEQ ID NO: 106 - RNA, 20 nt, synthetic construct
  misc_feature 1..20: note = Antisense Sequence
  source 1..20: mol_type = other RNA
ggtcagcgtggtaaggtttg

SEQ ID NO: 107 - RNA, 20 nt, synthetic construct
  misc_feature 1..20: note = Antisense Sequence
  source 1..20: mol_type = other RNA
aggtcagcgtggtaaggttt

SEQ ID NO: 108 - RNA, 20 nt, synthetic construct
  misc_feature 1..20: note = Antisense Sequence
  source 1..20: mol_type = other RNA
aaggtcagcgtggtaaggtt

SEQ ID NO: 109 - RNA, 20 nt, synthetic construct
  misc_feature 1..20: note = Antisense Sequence
  source 1..20: mol_type = other RNA
gaaggtcagcgtggtaaggt

SEQ ID NO: 110 - RNA, 20 nt, synthetic construct
  misc_feature 1..20: note = Antisense Sequence
  source 1..20: mol_type = other RNA
agaaggtcagcgtggtaagg

SEQ ID NO: 111 - RNA, 20 nt, synthetic construct
  misc_feature 1..20: note = Antisense Sequence
  source 1..20: mol_type = other RNA
ccagaaggtcagcgtggtaa

SEQ ID NO: 112 - RNA, 20 nt, synthetic construct
  misc_feature 1..20: note = Antisense Sequence
  source 1..20: mol_type = other RNA
cccagaaggtcagcgtggta

SEQ ID NO: 113 - RNA, 20 nt, synthetic construct
  misc_feature 1..20: note = Antisense Sequence
  source 1..20: mol_type = other RNA
tttctactttcgtggttccc

SEQ ID NO: 114 - RNA, 20 nt, synthetic construct
  misc_feature 1..20: note = Antisense Sequence
  source 1..20: mol_type = other RNA
atttctactttcgtggttcc

SEQ ID NO: 115 - RNA, 20 nt, synthetic construct
  misc_feature 1..20: note = Antisense Sequence
  source 1..20: mol_type = other RNA
gatttctactttcgtggttc

SEQ ID NO: 116 - RNA, 20 nt, synthetic construct
  misc_feature 1..20: note = Antisense Sequence
  source 1..20: mol_type = other RNA
gtgatttctactttcgtggt

SEQ ID NO: 117 - RNA, 20 nt, synthetic construct
  misc_feature 1..20: note = Antisense Sequence
  source 1..20: mol_type = other RNA
actggctgtgatttctactt

SEQ ID NO: 118 - RNA, 20 nt, synthetic construct
  misc_feature 1..20: note = Antisense Sequence
  source 1..20: mol_type = other RNA
gactggctgtgatttctact

SEQ ID NO: 119 - RNA, 20 nt, synthetic construct
  misc_feature 1..20: note = Antisense Sequence
  source 1..20: mol_type = other RNA
ctgactggctgtgatttcta

SEQ ID NO: 120 - RNA, 20 nt, synthetic construct
  misc_feature 1..20: note = Antisense Sequence
  source 1..20: mol_type = other RNA
tgcaggatgatggtgctggt

SEQ ID NO: 121 - RNA, 20 nt, synthetic construct
  misc_feature 1..20: note = Antisense Sequence
  source 1..20: mol_type = other RNA
atgcaggatgatggtgctgg

SEQ ID NO: 122 - RNA, 20 nt, synthetic construct
  misc_feature 1..20: note = Antisense Sequence
  source 1..20: mol_type = other RNA
ctatgcaggatgatggtgct

SEQ ID NO: 123 - RNA, 20 nt, synthetic construct
  misc_feature 1..20: note = Antisense Sequence
  source 1..20: mol_type = other RNA
tgactatgcaggatgatggt

SEQ ID NO: 124 - RNA, 20 nt, synthetic construct
  misc_feature 1..20: note = Antisense Sequence
  source 1..20: mol_type = other RNA
gtgactatgcaggatgatgg

SEQ ID NO: 125 - RNA, 20 nt, synthetic construct
  misc_feature 1..20: note = Antisense Sequence
  source 1..20: mol_type = other RNA
ggtgactatgcaggatgatg

SEQ ID NO: 126 - RNA, 20 nt, synthetic construct
  misc_feature 1..20: note = Antisense Sequence
  source 1..20: mol_type = other RNA
tggtgactatgcaggatgat

SEQ ID NO: 127 - RNA, 20 nt, synthetic construct
  misc_feature 1..20: note = Antisense Sequence
  source 1..20: mol_type = other RNA
gtggtgactatgcaggatga

SEQ ID NO: 128 - RNA, 20 nt, synthetic construct
  misc_feature 1..20: note = Antisense Sequence
  source 1..20: mol_type = other RNA
ggtggtgactatgcaggatg

SEQ ID NO: 129 - RNA, 20 nt, synthetic construct
  misc_feature 1..20: note = Antisense Sequence
  source 1..20: mol_type = other RNA
aggtggtgactatgcaggat

SEQ ID NO: 130 - RNA, 20 nt, synthetic construct
  misc_feature 1..20: note = Antisense Sequence
  source 1..20: mol_type = other RNA
caggtggtgactatgcagga

SEQ ID NO: 131 - RNA, 20 nt, synthetic construct
  misc_feature 1..20: note = Antisense Sequence
  source 1..20: mol_type = other RNA
gcaggtggtgactatgcagg

SEQ ID NO: 132 - RNA, 20 nt, synthetic construct
  misc_feature 1..20: note = Antisense Sequence
  source 1..20: mol_type = other RNA
tccgatagcctctctccagc

SEQ ID NO: 133 - RNA, 20 nt, synthetic construct
  misc_feature 1..20: note = Antisense Sequence
  source 1..20: mol_type = other RNA
ttccgatagcctctctccag

SEQ ID NO: 134 - RNA, 20 nt, synthetic construct
  misc_feature 1..20: note = Antisense Sequence
  source 1..20: mol_type = other RNA
cttccgatagcctctctcca

SEQ ID NO: 135 - RNA, 20 nt, synthetic construct
  misc_feature 1..20: note = Antisense Sequence
  source 1..20: mol_type = other RNA
tcttccgatagcctctctcc

SEQ ID NO: 136 - RNA, 20 nt, synthetic construct
  misc_feature 1..20: note = Antisense Sequence
  source 1..20: mol_type = other RNA
ttcttccgatagcctctctc

SEQ ID NO: 137 - RNA, 20 nt, synthetic construct
  misc_feature 1..20: note = Antisense Sequence
  source 1..20: mol_type = other RNA
gttcttccgatagcctctct

SEQ ID NO: 138 - RNA, 20 nt, synthetic construct
  misc_feature 1..20: note = Antisense Sequence
  source 1..20: mol_type = other RNA
ggttcttccgatagcctctc

SEQ ID NO: 139 - RNA, 20 nt, synthetic construct
  misc_feature 1..20: note = Antisense Sequence
  source 1..20: mol_type = other RNA
gggttcttccgatagcctct

SEQ ID NO: 140 - RNA, 20 nt, synthetic construct
  misc_feature 1..20: note = Antisense Sequence
  source 1..20: mol_type = other RNA
gagccagcagtgcaatttgc

SEQ ID NO: 141 - RNA, 20 nt, synthetic construct
  misc_feature 1..20: note = Antisense Sequence
  source 1..20: mol_type = other RNA
tcgggagccagcagtgcaat

SEQ ID NO: 142 - RNA, 20 nt, synthetic construct
  misc_feature 1..20: note = Antisense Sequence
  source 1..20: mol_type = other RNA
tgtgtacgggagcccgacaa

SEQ ID NO: 143 - RNA, 20 nt, synthetic construct
  misc_feature 1..20: note = Antisense Sequence
  source 1..20: mol_type = other RNA
aactgtgtacgggagcccga

SEQ ID NO: 144 - RNA, 20 nt, synthetic construct
  misc_feature 1..20: note = Antisense Sequence
  source 1..20: mol_type = other RNA
acaactgtgtacgggagccc

SEQ ID NO: 145 - RNA, 20 nt, synthetic construct
  misc_feature 1..20: note = Antisense Sequence
  source 1..20: mol_type = other RNA
gacaactgtgtacgggagcc

SEQ ID NO: 146 - RNA, 20 nt, synthetic construct
  misc_feature 1..20: note = Antisense Sequence
  source 1..20: mol_type = other RNA
tgacaactgtgtacgggagc

SEQ ID NO: 147 - RNA, 20 nt, synthetic construct
  misc_feature 1..20: note = Antisense Sequence
  source 1..20: mol_type = other RNA
atgacaactgtgtacgggag

SEQ ID NO: 148 - RNA, 20 nt, synthetic construct
  misc_feature 1..20: note = Antisense Sequence
  source 1..20: mol_type = other RNA
aatgacaactgtgtacggga

SEQ ID NO: 149 - RNA, 20 nt, synthetic construct
  misc_feature 1..20: note = Antisense Sequence
  source 1..20: mol_type = other RNA
gaatgacaactgtgtacggg

SEQ ID NO: 150 - RNA, 20 nt, synthetic construct
  misc_feature 1..20: note = Antisense Sequence
  source 1..20: mol_type = other RNA
gtgaatgacaactgtgtacg

SEQ ID NO: 151 - RNA, 20 nt, synthetic construct
  misc_feature 1..20: note = Antisense Sequence
  source 1..20: mol_type = other RNA
catagtgaatgacaactgtg

SEQ ID NO: 152 - RNA, 20 nt, synthetic construct
  misc_feature 1..20: note = Antisense Sequence
  source 1..20: mol_type = other RNA
gcatagtgaatgacaactgt

SEQ ID NO: 153 - RNA, 20 nt, synthetic construct
  misc_feature 1..20: note = Antisense Sequence
  source 1..20: mol_type = other RNA
agcatagtgaatgacaactg

SEQ ID NO: 154 - RNA, 20 nt, synthetic construct
  misc_feature 1..20: note = Antisense Sequence
  source 1..20: mol_type = other RNA
cagcatagtgaatgacaact

SEQ ID NO: 155 - RNA, 20 nt, synthetic construct
  misc_feature 1..20: note = Antisense Sequence
  source 1..20: mol_type = other RNA
ccagcatagtgaatgacaac

SEQ ID NO: 156 - RNA, 20 nt, synthetic construct
  misc_feature 1..20: note = Antisense Sequence
  source 1..20: mol_type = other RNA
gccagcatagtgaatgacaa

SEQ ID NO: 157 - RNA, 20 nt, synthetic construct
  misc_feature 1..20: note = Antisense Sequence
  source 1..20: mol_type = other RNA
tgccagcatagtgaatgaca

SEQ ID NO: 158 - RNA, 20 nt, synthetic construct
  misc_feature 1..20: note = Antisense Sequence
  source 1..20: mol_type = other RNA
ttgccagcatagtgaatgac

SEQ ID NO: 159 - RNA, 20 nt, synthetic construct
  misc_feature 1..20: note = Antisense Sequence
  source 1..20: mol_type = other RNA
aaagattgccagcatagtga

SEQ ID NO: 160 - RNA, 20 nt, synthetic construct
  misc_feature 1..20: note = Antisense Sequence
  source 1..20: mol_type = other RNA
gaaagattgccagcatagtg

SEQ ID NO: 161 - RNA, 20 nt, synthetic construct
  misc_feature 1..20: note = Antisense Sequence
  source 1..20: mol_type = other RNA
taaaatccgtggaaagtctc

SEQ ID NO: 162 - RNA, 20 nt, synthetic construct
  misc_feature 1..20: note = Antisense Sequence
  source 1..20: mol_type = other RNA
gtaaaatccgtggaaagtct

SEQ ID NO: 163 - RNA, 20 nt, synthetic construct
  misc_feature 1..20: note = Antisense Sequence
  source 1..20: mol_type = other RNA
tgtaaaatccgtggaaagtc

SEQ ID NO: 164 - RNA, 20 nt, synthetic construct
  misc_feature 1..20: note = Antisense Sequence
  source 1..20: mol_type = other RNA
gcttttgtaaaatccgtgga

SEQ ID NO: 165 - RNA, 20 nt, synthetic construct
  misc_feature 1..20: note = Antisense Sequence
  source 1..20: mol_type = other RNA
tgcttttgtaaaatccgtgg

SEQ ID NO: 166 - RNA, 20 nt, synthetic construct
  misc_feature 1..20: note = Antisense Sequence
  source 1..20: mol_type = other RNA
aggtgcttttgtaaaatccg

SEQ ID NO: 167 - RNA, 20 nt, synthetic construct
  misc_feature 1..20: note = Antisense Sequence
  source 1..20: mol_type = other RNA
gttctgtaggtgcttttgta

SEQ ID NO: 168 - RNA, 20 nt, synthetic construct
  misc_feature 1..20: note = Antisense Sequence
  source 1..20: mol_type = other RNA
ggttctgtaggtgcttttgt

SEQ ID NO: 169 - RNA, 20 nt, synthetic construct
  misc_feature 1..20: note = Antisense Sequence
  source 1..20: mol_type = other RNA
ttccttggttctgtaggtgc

SEQ ID NO: 170 - RNA, 20 nt, synthetic construct
  misc_feature 1..20: note = Antisense Sequence
  source 1..20: mol_type = other RNA
cttccttggttctgtaggtg

SEQ ID NO: 171 - RNA, 20 nt, synthetic construct
  misc_feature 1..20: note = Antisense Sequence
  source 1..20: mol_type = other RNA
cccttccttggttctgtagg

SEQ ID NO: 172 - RNA, 20 nt, synthetic construct
  misc_feature 1..20: note = Antisense Sequence
  source 1..20: mol_type = other RNA
tgctagtatcctcagttccc

SEQ ID NO: 173 - RNA, 20 nt, synthetic construct
  misc_feature 1..20: note = Antisense Sequence
  source 1..20: mol_type = other RNA
atgctagtatcctcagttcc

SEQ ID NO: 174 - RNA, 20 nt, synthetic construct
  misc_feature 1..20: note = Antisense Sequence
  source 1..20: mol_type = other RNA
gatgctagtatcctcagttc

SEQ ID NO: 175 - RNA, 20 nt, synthetic construct
  misc_feature 1..20: note = Antisense Sequence
  source 1..20: mol_type = other RNA
tgatgctagtatcctcagtt

SEQ ID NO: 176 - RNA, 20 nt, synthetic construct
  misc_feature 1..20: note = Antisense Sequence
  source 1..20: mol_type = other RNA
ttgatgctagtatcctcagt

SEQ ID NO: 177 - RNA, 20 nt, synthetic construct
  misc_feature 1..20: note = Antisense Sequence
  source 1..20: mol_type = other RNA
gttgatgctagtatcctcag

SEQ ID NO: 178 - RNA, 20 nt, synthetic construct
  misc_feature 1..20: note = Antisense Sequence
  source 1..20: mol_type = other RNA
tgttgatgctagtatcctca

SEQ ID NO: 179 - RNA, 20 nt, synthetic construct
  misc_feature 1..20: note = Antisense Sequence
  source 1..20: mol_type = other RNA
gtgttgatgctagtatcctc

SEQ ID NO: 180 - RNA, 20 nt, synthetic construct
  misc_feature 1..20: note = Antisense Sequence
  source 1..20: mol_type = other RNA
agggaaaggccattctagct

SEQ ID NO: 181 - RNA, 20 nt, synthetic construct
  misc_feature 1..20: note = Antisense Sequence
  source 1..20: mol_type = other RNA
cagggaaaggccattctagc

SEQ ID NO: 182 - RNA, 20 nt, synthetic construct
  misc_feature 1..20: note = Antisense Sequence
  source 1..20: mol_type = other RNA
aaagcagggaaaggccattc

SEQ ID NO: 183 - RNA, 20 nt, synthetic construct
  misc_feature 1..20: note = Antisense Sequence
  source 1..20: mol_type = other RNA
catcaaagcagggaaaggcc

SEQ ID NO: 184 - RNA, 20 nt, synthetic construct
  misc_feature 1..20: note = Antisense Sequence
  source 1..20: mol_type = other RNA
gttcatcaaagcagggaaag

SEQ ID NO: 185 - RNA, 20 nt, synthetic construct
  misc_feature 1..20: note = Antisense Sequence
  source 1..20: mol_type = other RNA
caggttcatcaaagcaggga

SEQ ID NO: 186 - RNA, 20 nt, synthetic construct
  misc_feature 1..20: note = Antisense Sequence
  source 1..20: mol_type = other RNA
aggcaggttcatcaaagcag

SEQ ID NO: 187 - RNA, 20 nt, synthetic construct
  misc_feature 1..20: note = Antisense Sequence
  source 1..20: mol_type = other RNA
aaggcaggttcatcaaagca

SEQ ID NO: 188 - RNA, 20 nt, synthetic construct
  misc_feature 1..20: note = Antisense Sequence
  source 1..20: mol_type = other RNA
gaaggcaggttcatcaaagc

SEQ ID NO: 189 - RNA, 20 nt, synthetic construct
  misc_feature 1..20: note = Antisense Sequence
  source 1..20: mol_type = other RNA
aaacttgctttgaaggcagg

SEQ ID NO: 190 - RNA, 20 nt, synthetic construct
  misc_feature 1..20: note = Antisense Sequence
  source 1..20: mol_type = other RNA
gaaacttgctttgaaggcag

SEQ ID NO: 191 - RNA, 20 nt, synthetic construct
  misc_feature 1..20: note = Antisense Sequence
  source 1..20: mol_type = other RNA
agaaacttgctttgaaggca

SEQ ID NO: 192 - RNA, 20 nt, synthetic construct
  misc_feature 1..20: note = Antisense Sequence
  source 1..20: mol_type = other RNA
tgccttggctctcttctaat

SEQ ID NO: 193 - RNA, 20 nt, synthetic construct
  misc_feature 1..20: note = Antisense Sequence
  source 1..20: mol_type = other RNA
gtgccttggctctcttctaa

SEQ ID NO: 194 - RNA, 20 nt, synthetic construct
  misc_feature 1..20: note = Antisense Sequence
  source 1..20: mol_type = other RNA
taggtgccttggctctcttc

SEQ ID NO: 195 - RNA, 20 nt, synthetic construct
  misc_feature 1..20: note = Antisense Sequence
  source 1..20: mol_type = other RNA
tggctaggtgccttggctct

SEQ ID NO: 196 - RNA, 20 nt, synthetic construct
  misc_feature 1..20: note = Antisense Sequence
  source 1..20: mol_type = other RNA
atggctaggtgccttggctc

SEQ ID NO: 197 - RNA, 20 nt, synthetic construct
  misc_feature 1..20: note = Antisense Sequence
  source 1..20: mol_type = other RNA
gatggctaggtgccttggct

SEQ ID NO: 198 - RNA, 20 nt, synthetic construct
  misc_feature 1..20: note = Antisense Sequence
  source 1..20: mol_type = other RNA
agatggctaggtgccttggc

SEQ ID NO: 199 - RNA, 20 nt, synthetic construct
  misc_feature 1..20: note = Antisense Sequence
  source 1..20: mol_type = other RNA
gagatggctaggtgccttgg

SEQ ID NO: 200 - RNA, 20 nt, synthetic construct
  misc_feature 1..20: note = Antisense Sequence
  source 1..20: mol_type = other RNA
ggagatggctaggtgccttg

SEQ ID NO: 201 - RNA, 20 nt, synthetic construct
  misc_feature 1..20: note = Antisense Sequence
  source 1..20: mol_type = other RNA
ttggagatggctaggtgcct

SEQ ID NO: 202 - RNA, 20 nt, synthetic construct
  misc_feature 1..20: note = Antisense Sequence
  source 1..20: mol_type = other RNA
attggagatggctaggtgcc

SEQ ID NO: 203 - RNA, 20 nt, synthetic construct
  misc_feature 1..20: note = Antisense Sequence
  source 1..20: mol_type = other RNA
tattggagatggctaggtgc

SEQ ID NO: 204 - RNA, 20 nt, synthetic construct
  misc_feature 1..20: note = Antisense Sequence
  source 1..20: mol_type = other RNA
catattggagatggctaggt

SEQ ID NO: 205 - RNA, 20 nt, synthetic construct
  misc_feature 1..20: note = Antisense Sequence
  source 1..20: mol_type = other RNA
gcatattggagatggctagg

SEQ ID NO: 206 - RNA, 20 nt, synthetic construct
  misc_feature 1..20: note = Antisense Sequence
  source 1..20: mol_type = other RNA
ggcatattggagatggctag

SEQ ID NO: 207 - RNA, 20 nt, synthetic construct
  misc_feature 1..20: note = Antisense Sequence
  source 1..20: mol_type = other RNA
atggcatattggagatggct

SEQ ID NO: 208 - RNA, 20 nt, synthetic construct
  misc_feature 1..20: note = Antisense Sequence
  source 1..20: mol_type = other RNA
cagatttcaccaatggcata

SEQ ID NO: 209 - RNA, 20 nt, synthetic construct
  misc_feature 1..20: note = Antisense Sequence
  source 1..20: mol_type = other RNA
acagatttcaccaatggcat

SEQ ID NO: 210 - RNA, 20 nt, synthetic construct
  misc_feature 1..20: note = Antisense Sequence
  source 1..20: mol_type = other RNA
cacagatttcaccaatggca

SEQ ID NO: 211 - RNA, 20 nt, synthetic construct
  misc_feature 1..20: note = Antisense Sequence
  source 1..20: mol_type = other RNA
tcacagatttcaccaatggc

SEQ ID NO: 212 - RNA, 20 nt, synthetic construct
  misc_feature 1..20: note = Antisense Sequence
  source 1..20: mol_type = other RNA
gtcacagatttcaccaatgg

SEQ ID NO: 213 - RNA, 20 nt, synthetic construct
  misc_feature 1..20: note = Antisense Sequence
  source 1..20: mol_type = other RNA
agtcacagatttcaccaatg

SEQ ID NO: 214 - RNA, 20 nt, synthetic construct
  misc_feature 1..20: note = Antisense Sequence
  source 1..20: mol_type = other RNA
cagtcacagatttcaccaat

SEQ ID NO: 215 - RNA, 20 nt, synthetic construct
  misc_feature 1..20: note = Antisense Sequence
  source 1..20: mol_type = other RNA
acagtcacagatttcaccaa

SEQ ID NO: 216 - RNA, 20 nt, synthetic construct
  misc_feature 1..20: note = Antisense Sequence
  source 1..20: mol_type = other RNA
ttcagcaacagtcacagatt

SEQ ID NO: 217 - RNA, 20 nt, synthetic construct
  misc_feature 1..20: note = Antisense Sequence
  source 1..20: mol_type = other RNA
cttcagcaacagtcacagat

SEQ ID NO: 218 - RNA, 20 nt, synthetic construct
  misc_feature 1..20: note = Antisense Sequence
  source 1..20: mol_type = other RNA
gtccttcagcaacagtcaca

SEQ ID NO: 219 - RNA, 20 nt, synthetic construct
  misc_feature 1..20: note = Antisense Sequence
  source 1..20: mol_type = other RNA
agtccttcagcaacagtcac

SEQ ID NO: 220 - RNA, 20 nt, synthetic construct
  misc_feature 1..20: note = Antisense Sequence
  source 1..20: mol_type = other RNA
gagtccttcagcaacagtca

SEQ ID NO: 221 - RNA, 20 nt, synthetic construct
  misc_feature 1..20: note = Antisense Sequence
  source 1..20: mol_type = other RNA
ctatgagtccttcagcaaca

SEQ ID NO: 222 - RNA, 20 nt, synthetic construct
  misc_feature 1..20: note = Antisense Sequence
  source 1..20: mol_type = other RNA
tctatgagtccttcagcaac

SEQ ID NO: 223 - RNA, 20 nt, synthetic construct
  misc_feature 1..20: note = Antisense Sequence
  source 1..20: mol_type = other RNA
ttctatgagtccttcagcaa

SEQ ID NO: 224 - RNA, 20 nt, synthetic construct
  misc_feature 1..20: note = Antisense Sequence
  source 1..20: mol_type = other RNA
cttctatgagtccttcagca

SEQ ID NO: 225 - RNA, 20 nt, synthetic construct
  misc_feature 1..20: note = Antisense Sequence
  source 1..20: mol_type = other RNA
gtcttctatgagtccttcag

SEQ ID NO: 226 - RNA, 20 nt, synthetic construct
  misc_feature 1..20: note = Antisense Sequence
  source 1..20: mol_type = other RNA
aatggtcttctatgagtcct

SEQ ID NO: 227 - RNA, 20 nt, synthetic construct
  misc_feature 1..20: note = Antisense Sequence
  source 1..20: mol_type = other RNA
aaatggtcttctatgagtcc

SEQ ID NO: 228 - RNA, 20 nt, synthetic construct
  misc_feature 1..20: note = Antisense Sequence
  source 1..20: mol_type = other RNA
tcacagtgacatcaaaatgg

SEQ ID NO: 229 - RNA, 20 nt, synthetic construct
  misc_feature 1..20: note = Antisense Sequence
  source 1..20: mol_type = other RNA
tcatcttcacagtgacatca

SEQ ID NO: 230 - RNA, 20 nt, synthetic construct
  misc_feature 1..20: note = Antisense Sequence
  source 1..20: mol_type = other RNA
gctcatcttcacagtgacat

SEQ ID NO: 231 - RNA, 20 nt, synthetic construct
  misc_feature 1..20: note = Antisense Sequence
  source 1..20: mol_type = other RNA
tgctcatcttcacagtgaca

SEQ ID NO: 232 - RNA, 20 nt, synthetic construct
  misc_feature 1..20: note = Antisense Sequence
  source 1..20: mol_type = other RNA
ggtgctcatcttcacagtga

SEQ ID NO: 233 - RNA, 20 nt, synthetic construct
  misc_feature 1..20: note = Antisense Sequence
  source 1..20: mol_type = other RNA
aggtgctcatcttcacagtg

SEQ ID NO: 234 - RNA, 20 nt, synthetic construct
  misc_feature 1..20: note = Antisense Sequence
  source 1..20: mol_type = other RNA
ataggtgctcatcttcacag

SEQ ID NO: 235 - RNA, 20 nt, synthetic construct
  misc_feature 1..20: note = Antisense Sequence
  source 1..20: mol_type = other RNA
gataggtgctcatcttcaca

SEQ ID NO: 236 - RNA, 20 nt, synthetic construct
  misc_feature 1..20: note = Antisense Sequence
  source 1..20: mol_type = other RNA
atgaaggccaccagataggt

SEQ ID NO: 237 - RNA, 20 nt, synthetic construct
  misc_feature 1..20: note = Antisense Sequence
  source 1..20: mol_type = other RNA
tgatgaaggccaccagatag

SEQ ID NO: 238 - RNA, 20 nt, synthetic construct
  misc_feature 1..20: note = Antisense Sequence
  source 1..20: mol_type = other RNA
atgatgaaggccaccagata

SEQ ID NO: 239 - RNA, 20 nt, synthetic construct
  misc_feature 1..20: note = Antisense Sequence
  source 1..20: mol_type = other RNA
aatgatgaaggccaccagat

SEQ ID NO: 240 - RNA, 20 nt, synthetic construct
  misc_feature 1..20: note = Antisense Sequence
  source 1..20: mol_type = other RNA
gaaatgatgaaggccaccag

SEQ ID NO: 241 - RNA, 20 nt, synthetic construct
  misc_feature 1..20: note = Antisense Sequence
  source 1..20: mol_type = other RNA
tgaaatgatgaaggccacca

SEQ ID NO: 242 - RNA, 20 nt, synthetic construct
  misc_feature 1..20: note = Antisense Sequence
  source 1..20: mol_type = other RNA
tgctgacagactcaaaatct

SEQ ID NO: 243 - RNA, 20 nt, synthetic construct
  misc_feature 1..20: note = Antisense Sequence
  source 1..20: mol_type = other RNA
tcttgctgacagactcaaaa

SEQ ID NO: 244 - RNA, 20 nt, synthetic construct
  misc_feature 1..20: note = Antisense Sequence
  source 1..20: mol_type = other RNA
gttatcttgctgacagactc

SEQ ID NO: 245 - RNA, 20 nt, synthetic construct
  misc_feature 1..20: note = Antisense Sequence
  source 1..20: mol_type = other RNA
ggttatcttgctgacagact

SEQ ID NO: 246 - RNA, 20 nt, synthetic construct
  misc_feature 1..20: note = Antisense Sequence
  source 1..20: mol_type = other RNA
tggttatcttgctgacagac

SEQ ID NO: 247 - RNA, 20 nt, synthetic construct
  misc_feature 1..20: note = Antisense Sequence
  source 1..20: mol_type = other RNA
cttggttatcttgctgacag

SEQ ID NO: 248 - RNA, 20 nt, synthetic construct
  misc_feature 1..20: note = Antisense Sequence
  source 1..20: mol_type = other RNA
ctcttggttatcttgctgac

SEQ ID NO: 249 - RNA, 20 nt, synthetic construct
  misc_feature 1..20: note = Antisense Sequence
  source 1..20: mol_type = other RNA
actcttggttatcttgctga

SEQ ID NO: 250 - RNA, 20 nt, synthetic construct
  misc_feature 1..20: note = Antisense Sequence
  source 1..20: mol_type = other RNA
cactcttggttatcttgctg

SEQ ID NO: 251 - RNA, 20 nt, synthetic construct
  misc_feature 1..20: note = Antisense Sequence
  source 1..20: mol_type = other RNA
ccactcttggttatcttgct

SEQ ID NO: 252 - RNA, 20 nt, synthetic construct
  misc_feature 1..20: note = Antisense Sequence
  source 1..20: mol_type = other RNA
gactccactcttggttatct

SEQ ID NO: 253 - RNA, 20 nt, synthetic construct
  misc_feature 1..20: note = Antisense Sequence
  source 1..20: mol_type = other RNA
tgactccactcttggttatc

SEQ ID NO: 254 - RNA, 20 nt, synthetic construct
  misc_feature 1..20: note = Antisense Sequence
  source 1..20: mol_type = other RNA
ttgactccactcttggttat

SEQ ID NO: 255 - RNA, 20 nt, synthetic construct
  misc_feature 1..20: note = Antisense Sequence
  source 1..20: mol_type = other RNA
cttgactccactcttggtta

SEQ ID NO: 256 - RNA, 20 nt, synthetic construct
  misc_feature 1..20: note = Antisense Sequence
  source 1..20: mol_type = other RNA
accttgactccactcttggt

SEQ ID NO: 257 - RNA, 20 nt, synthetic construct
  misc_feature 1..20: note = Antisense Sequence
  source 1..20: mol_type = other RNA
aaccttgactccactcttgg

SEQ ID NO: 258 - RNA, 20 nt, synthetic construct
  misc_feature 1..20: note = Antisense Sequence
  source 1..20: mol_type = other RNA
aaaccttgactccactcttg

SEQ ID NO: 259 - RNA, 20 nt, synthetic construct
  misc_feature 1..20: note = Antisense Sequence
  source 1..20: mol_type = other RNA
agaaaccttgactccactct

SEQ ID NO: 260 - RNA, 20 nt, synthetic construct
  misc_feature 1..20: note = Antisense Sequence
  source 1..20: mol_type = other RNA
cagaaaccttgactccactc

SEQ ID NO: 261 - RNA, 20 nt, synthetic construct
  misc_feature 1..20: note = Antisense Sequence
  source 1..20: mol_type = other RNA
aaacagaaaccttgactcca

SEQ ID NO: 262 - RNA, 20 nt, synthetic construct
  misc_feature 1..20: note = Antisense Sequence
  source 1..20: mol_type = other RNA
taaacagaaaccttgactcc

SEQ ID NO: 263 - RNA, 20 nt, synthetic construct
  misc_feature 1..20: note = Antisense Sequence
  source 1..20: mol_type = other RNA
gcataaacagaaaccttgac

SEQ ID NO: 264 - RNA, 20 nt, synthetic construct
  misc_feature 1..20: note = Antisense Sequence
  source 1..20: mol_type = other RNA
cagcataaacagaaaccttg

SEQ ID NO: 265 - RNA, 20 nt, synthetic construct
  misc_feature 1..20: note = Antisense Sequence
  source 1..20: mol_type = other RNA
tcttgtctggcacagcataa

SEQ ID NO: 266 - RNA, 20 nt, synthetic construct
  misc_feature 1..20: note = Antisense Sequence
  source 1..20: mol_type = other RNA
cagtgcataatctgcttgat

SEQ ID NO: 267 - RNA, 20 nt, synthetic construct
  misc_feature 1..20: note = Antisense Sequence
  source 1..20: mol_type = other RNA
ccagtgcataatctgcttga

SEQ ID NO: 268 - RNA, 20 nt, synthetic construct
  misc_feature 1..20: note = Antisense Sequence
  source 1..20: mol_type = other RNA
tccagtgcataatctgcttg

SEQ ID NO: 269 - RNA, 20 nt, synthetic construct
  misc_feature 1..20: note = Antisense Sequence
  source 1..20: mol_type = other RNA
atccagtgcataatctgctt

SEQ ID NO: 270 - RNA, 20 nt, synthetic construct
  misc_feature 1..20: note = Antisense Sequence
  source 1..20: mol_type = other RNA
catccagtgcataatctgct

SEQ ID NO: 271 - RNA, 20 nt, synthetic construct
  misc_feature 1..20: note = Antisense Sequence
  source 1..20: mol_type = other RNA
gcatccagtgcataatctgc

SEQ ID NO: 272 - RNA, 20 nt, synthetic construct
  misc_feature 1..20: note = Antisense Sequence
  source 1..20: mol_type = other RNA
agcatccagtgcataatctg

SEQ ID NO: 273 - RNA, 20 nt, synthetic construct
  misc_feature 1..20: note = Antisense Sequence
  source 1..20: mol_type = other RNA
cgcagcatccagtgcataat

SEQ ID NO: 274 - RNA, 20 nt, synthetic construct
  misc_feature 1..20: note = Antisense Sequence
  source 1..20: mol_type = other RNA
caccgcagcatccagtgcat

SEQ ID NO: 275 - RNA, 20 nt, synthetic construct
  misc_feature 1..20: note = Antisense Sequence
  source 1..20: mol_type = other RNA
tcaccgcagcatccagtgca

SEQ ID NO: 276 - RNA, 20 nt, synthetic construct
  misc_feature 1..20: note = Antisense Sequence
  source 1..20: mol_type = other RNA
agtcaccgcagcatccagtg

SEQ ID NO: 277 - RNA, 20 nt, synthetic construct
  misc_feature 1..20: note = Antisense Sequence
  source 1..20: mol_type = other RNA
gagtcaccgcagcatccagt

SEQ ID NO: 278 - RNA, 20 nt, synthetic construct
  misc_feature 1..20: note = Antisense Sequence
  source 1..20: mol_type = other RNA
agagtcaccgcagcatccag

SEQ ID NO: 279 - RNA, 20 nt, synthetic construct
  misc_feature 1..20: note = Antisense Sequence
  source 1..20: mol_type = other RNA
aagagtcaccgcagcatcca

SEQ ID NO: 280 - RNA, 20 nt, synthetic construct
  misc_feature 1..20: note = Antisense Sequence
  source 1..20: mol_type = other RNA
gaagagtcaccgcagcatcc

SEQ ID NO: 281 - RNA, 20 nt, synthetic construct
  misc_feature 1..20: note = Antisense Sequence
  source 1..20: mol_type = other RNA
agaagagtcaccgcagcatc

SEQ ID NO: 282 - RNA, 20 nt, synthetic construct
  misc_feature 1..20: note = Antisense Sequence
  source 1..20: mol_type = other RNA
tagaagagtcaccgcagcat

SEQ ID NO: 283 - RNA, 20 nt, synthetic construct
  misc_feature 1..20: note = Antisense Sequence
  source 1..20: mol_type = other RNA
ctagaagagtcaccgcagca

SEQ ID NO: 284 - RNA, 20 nt, synthetic construct
  misc_feature 1..20: note = Antisense Sequence
  source 1..20: mol_type = other RNA
tcgggaatagcagcaagatc

SEQ ID NO: 285 - RNA, 20 nt, synthetic construct
  misc_feature 1..20: note = Antisense Sequence
  source 1..20: mol_type = other RNA
aagtcgggaatagcagcaag

SEQ ID NO: 286 - RNA, 20 nt, synthetic construct
  misc_feature 1..20: note = Antisense Sequence
  source 1..20: mol_type = other RNA
aaagtcgggaatagcagcaa

SEQ ID NO: 287 - RNA, 20 nt, synthetic construct
  misc_feature 1..20: note = Antisense Sequence
  source 1..20: mol_type = other RNA
gaaagtcgggaatagcagca

SEQ ID NO: 288 - RNA, 20 nt, synthetic construct
  misc_feature 1..20: note = Antisense Sequence
  source 1..20: mol_type = other RNA
tgaaagtcgggaatagcagc

SEQ ID NO: 289 - RNA, 20 nt, synthetic construct
  misc_feature 1..20: note = Antisense Sequence
  source 1..20: mol_type = other RNA
ctgaaagtcgggaatagcag

SEQ ID NO: 290 - RNA, 20 nt, synthetic construct
  misc_feature 1..20: note = Antisense Sequence
  source 1..20: mol_type = other RNA
actgaaagtcgggaatagca

SEQ ID NO: 291 - RNA, 20 nt, synthetic construct
  misc_feature 1..20: note = Antisense Sequence
  source 1..20: mol_type = other RNA
catagcaccagactgaaagt

SEQ ID NO: 292 - RNA, 20 nt, synthetic construct
  misc_feature 1..20: note = Antisense Sequence
  source 1..20: mol_type = other RNA
tccatagcaccagactgaaa

SEQ ID NO: 293 - RNA, 20 nt, synthetic construct
  misc_feature 1..20: note = Antisense Sequence
  source 1..20: mol_type = other RNA
ttccatagcaccagactgaa

SEQ ID NO: 294 - RNA, 20 nt, synthetic construct
  misc_feature 1..20: note = Antisense Sequence
  source 1..20: mol_type = other RNA
tttccatagcaccagactga

SEQ ID NO: 295 - RNA, 20 nt, synthetic construct
  misc_feature 1..20: note = Antisense Sequence
  source 1..20: mol_type = other RNA
ttttccatagcaccagactg

SEQ ID NO: 296 - RNA, 20 nt, synthetic construct
  misc_feature 1..20: note = Antisense Sequence
  source 1..20: mol_type = other RNA
gttttccatagcaccagact

SEQ ID NO: 297 - RNA, 20 nt, synthetic construct
  misc_feature 1..20: note = Antisense Sequence
  source 1..20: mol_type = other RNA
agttttccatagcaccagac

SEQ ID NO: 298 - RNA, 20 nt, synthetic construct
  misc_feature 1..20: note = Antisense Sequence
  source 1..20: mol_type = other RNA
cagttttccatagcaccaga

SEQ ID NO: 299 - RNA, 20 nt, synthetic construct
  misc_feature 1..20: note = Antisense Sequence
  source 1..20: mol_type = other RNA
ccagttttccatagcaccag

SEQ ID NO: 300 - RNA, 20 nt, synthetic construct
  misc_feature 1..20: note = Antisense Sequence
  source 1..20: mol_type = other RNA
ctctatatgttgtcagtccc

SEQ ID NO: 301 - RNA, 20 nt, synthetic construct
  misc_feature 1..20: note = Antisense Sequence
  source 1..20: mol_type = other RNA
cttgatgcagaagacttttc

SEQ ID NO: 302 - RNA, 20 nt, synthetic construct
  misc_feature 1..20: note = Antisense Sequence
  source 1..20: mol_type = other RNA
gcttacttgatgcagaagac

SEQ ID NO: 303 - RNA, 20 nt, synthetic construct
  misc_feature 1..20: note = Antisense Sequence
  source 1..20: mol_type = other RNA
cagttcatgggccacagtca

SEQ ID NO: 304 - RNA, 20 nt, synthetic construct
  misc_feature 1..20: note = Antisense Sequence
  source 1..20: mol_type = other RNA
gccagttcatgggccacagt

SEQ ID NO: 305 - RNA, 20 nt, synthetic construct
  misc_feature 1..20: note = Antisense Sequence
  source 1..20: mol_type = other RNA
tagtgaccaggttcccaaac

SEQ ID NO: 306 - RNA, 20 nt, synthetic construct
  misc_feature 1..20: note = Antisense Sequence
  source 1..20: mol_type = other RNA
atagtgaccaggttcccaaa

SEQ ID NO: 307 - RNA, 20 nt, synthetic construct
  misc_feature 1..20: note = Antisense Sequence
  source 1..20: mol_type = other RNA
tccatagtgaccaggttccc

SEQ ID NO: 308 - RNA, 20 nt, synthetic construct
  misc_feature 1..20: note = Antisense Sequence
  source 1..20: mol_type = other RNA
ttccatagtgaccaggttcc

SEQ ID NO: 309 - RNA, 20 nt, synthetic construct
  misc_feature 1..20: note = Antisense Sequence
  source 1..20: mol_type = other RNA
attccatagtgaccaggttc

SEQ ID NO: 310 - RNA, 20 nt, synthetic construct
  misc_feature 1..20: note = Antisense Sequence
  source 1..20: mol_type = other RNA
cattccatagtgaccaggtt

SEQ ID NO: 311 - RNA, 20 nt, synthetic construct
  misc_feature 1..20: note = Antisense Sequence
  source 1..20: mol_type = other RNA
ccattccatagtgaccaggt

SEQ ID NO: 312 - RNA, 20 nt, synthetic construct
  misc_feature 1..20: note = Antisense Sequence
  source 1..20: mol_type = other RNA
accattccatagtgaccagg

SEQ ID NO: 313 - RNA, 20 nt, synthetic construct
  misc_feature 1..20: note = Antisense Sequence
  source 1..20: mol_type = other RNA
caccattccatagtgaccag

SEQ ID NO: 314 - RNA, 20 nt, synthetic construct
  misc_feature 1..20: note = Antisense Sequence
  source 1..20: mol_type = other RNA
ccaccattccatagtgacca

SEQ ID NO: 315 - RNA, 20 nt, synthetic construct
  misc_feature 1..20: note = Antisense Sequence
  source 1..20: mol_type = other RNA
tccaccattccatagtgacc

SEQ ID NO: 316 - RNA, 20 nt, synthetic construct
  misc_feature 1..20: note = Antisense Sequence
  source 1..20: mol_type = other RNA
attccaccattccatagtga

SEQ ID NO: 317 - RNA, 20 nt, synthetic construct
  misc_feature 1..20: note = Antisense Sequence
  source 1..20: mol_type = other RNA
atcattccaccattccatag

SEQ ID NO: 318 - RNA, 20 nt, synthetic construct
  misc_feature 1..20: note = Antisense Sequence
  source 1..20: mol_type = other RNA
gatcattccaccattccata

SEQ ID NO: 319 - RNA, 20 nt, synthetic construct
  misc_feature 1..20: note = Antisense Sequence
  source 1..20: mol_type = other RNA
aagatcattccaccattcca

SEQ ID NO: 320 - RNA, 20 nt, synthetic construct
  misc_feature 1..20: note = Antisense Sequence
  source 1..20: mol_type = other RNA
aaagatcattccaccattcc

SEQ ID NO: 321 - RNA, 20 nt, synthetic construct
  misc_feature 1..20: note = Antisense Sequence
  source 1..20: mol_type = other RNA
caaagatcattccaccattc

SEQ ID NO: 322 - RNA, 20 nt, synthetic construct
  misc_feature 1..20: note = Antisense Sequence
  source 1..20: mol_type = other RNA
ccaaagatcattccaccatt

SEQ ID NO: 323 - RNA, 20 nt, synthetic construct
  misc_feature 1..20: note = Antisense Sequence
  source 1..20: mol_type = other RNA
gccaaagatcattccaccat

SEQ ID NO: 324 - RNA, 20 nt, synthetic construct
  misc_feature 1..20: note = Antisense Sequence
  source 1..20: mol_type = other RNA
agccaaagatcattccacca

SEQ ID NO: 325 - RNA, 20 nt, synthetic construct
  misc_feature 1..20: note = Antisense Sequence
  source 1..20: mol_type = other RNA
tagccaaagatcattccacc

SEQ ID NO: 326 - RNA, 20 nt, synthetic construct
  misc_feature 1..20: note = Antisense Sequence
  source 1..20: mol_type = other RNA
gacagacacaaactccataa

SEQ ID NO: 327 - RNA, 20 nt, synthetic construct
  misc_feature 1..20: note = Antisense Sequence
  source 1..20: mol_type = other RNA
gttcaggatgggtcacactg

SEQ ID NO: 328 - RNA, 20 nt, synthetic construct
  misc_feature 1..20: note = Antisense Sequence
  source 1..20: mol_type = other RNA
agttcaggatgggtcacact

SEQ ID NO: 329 - RNA, 20 nt, synthetic construct
  misc_feature 1..20: note = Antisense Sequence
  source 1..20: mol_type = other RNA
cagttcaggatgggtcacac

SEQ ID NO: 330 - RNA, 20 nt, synthetic construct
  misc_feature 1..20: note = Antisense Sequence
  source 1..20: mol_type = other RNA
tcagttcaggatgggtcaca

SEQ ID NO: 331 - RNA, 20 nt, synthetic construct
  misc_feature 1..20: note = Antisense Sequence
  source 1..20: mol_type = other RNA
ctttcagttcaggatgggtc

SEQ ID NO: 332 - RNA, 20 nt, synthetic construct
  misc_feature 1..20: note = Antisense Sequence
  source 1..20: mol_type = other RNA
aaagcatctacctccattgc

SEQ ID NO: 333 - RNA, 20 nt, synthetic construct
  misc_feature 1..20: note = Antisense Sequence
  source 1..20: mol_type = other RNA
tttccacaggtgtagacaca

SEQ ID NO: 334 - RNA, 20 nt, synthetic construct
  misc_feature 1..20: note = Antisense Sequence
  source 1..20: mol_type = other RNA
ttttccacaggtgtagacac

SEQ ID NO: 335 - RNA, 20 nt, synthetic construct
  misc_feature 1..20: note = Antisense Sequence
  source 1..20: mol_type = other RNA
attttccacaggtgtagaca

SEQ ID NO: 336 - RNA, 20 nt, synthetic construct
  misc_feature 1..20: note = Antisense Sequence
  source 1..20: mol_type = other RNA
aggattttccacaggtgtag

SEQ ID NO: 337 - RNA, 20 nt, synthetic construct
  misc_feature 1..20: note = Antisense Sequence
  source 1..20: mol_type = other RNA
gcaggattttccacaggtgt

SEQ ID NO: 338 - RNA, 20 nt, synthetic construct
  misc_feature 1..20: note = Antisense Sequence
  source 1..20: mol_type = other RNA
agcaggattttccacaggtg

SEQ ID NO: 339 - RNA, 20 nt, synthetic construct
  misc_feature 1..20: note = Antisense Sequence
  source 1..20: mol_type = other RNA
gagcaggattttccacaggt

SEQ ID NO: 340 - RNA, 20 nt, synthetic construct
  misc_feature 1..20: note = Antisense Sequence
  source 1..20: mol_type = other RNA
tgagcaggattttccacagg

SEQ ID NO: 341 - RNA, 20 nt, synthetic construct
  misc_feature 1..20: note = Antisense Sequence
  source 1..20: mol_type = other RNA
ctgagcaggattttccacag

SEQ ID NO: 342 - RNA, 20 nt, synthetic construct
  misc_feature 1..20: note = Antisense Sequence
  source 1..20: mol_type = other RNA
cggatctgagcaggattttc

SEQ ID NO: 343 - RNA, 20 nt, synthetic construct
  misc_feature 1..20: note = Antisense Sequence
  source 1..20: mol_type = other RNA
ctcccggatctgagcaggat

SEQ ID NO: 344 - RNA, 20 nt, synthetic construct
  misc_feature 1..20: note = Antisense Sequence
  source 1..20: mol_type = other RNA
acatctcccggatctgagca

SEQ ID NO: 345 - RNA, 20 nt, synthetic construct
  misc_feature 1..20: note = Antisense Sequence
  source 1..20: mol_type = other RNA
aaacatctcccggatctgag

SEQ ID NO: 346 - RNA, 20 nt, synthetic construct
  misc_feature 1..20: note = Antisense Sequence
  source 1..20: mol_type = other RNA
caaacatctcccggatctga

SEQ ID NO: 347 - RNA, 20 nt, synthetic construct
  misc_feature 1..20: note = Antisense Sequence
  source 1..20: mol_type = other RNA
tcaaacatctcccggatctg

SEQ ID NO: 348 - RNA, 20 nt, synthetic construct
  misc_feature 1..20: note = Antisense Sequence
  source 1..20: mol_type = other RNA
atcaaacatctcccggatct

SEQ ID NO: 349 - RNA, 20 nt, synthetic construct
  misc_feature 1..20: note = Antisense Sequence
  source 1..20: mol_type = other RNA
catcaaacatctcccggatc

SEQ ID NO: 350 - RNA, 20 nt, synthetic construct
  misc_feature 1..20: note = Antisense Sequence
  source 1..20: mol_type = other RNA
tcatcaaacatctcccggat

SEQ ID NO: 351 - RNA, 20 nt, synthetic construct
  misc_feature 1..20: note = Antisense Sequence
  source 1..20: mol_type = other RNA
catcatcaaacatctcccgg

SEQ ID NO: 352 - RNA, 20 nt, synthetic construct
  misc_feature 1..20: note = Antisense Sequence
  source 1..20: mol_type = other RNA
acatcatcaaacatctcccg

SEQ ID NO: 353 - RNA, 20 nt, synthetic construct
  misc_feature 1..20: note = Antisense Sequence
  source 1..20: mol_type = other RNA
aacatcatcaaacatctccc

SEQ ID NO: 354 - RNA, 20 nt, synthetic construct
  misc_feature 1..20: note = Antisense Sequence
  source 1..20: mol_type = other RNA
gaatacaagctcccttatca

SEQ ID NO: 355 - RNA, 20 nt, synthetic construct
  misc_feature 1..20: note = Antisense Sequence
  source 1..20: mol_type = other RNA
agaatacaagctcccttatc

SEQ ID NO: 356 - RNA, 20 nt, synthetic construct
  misc_feature 1..20: note = Antisense Sequence
  source 1..20: mol_type = other RNA
cagaatacaagctcccttat

SEQ ID NO: 357 - RNA, 20 nt, synthetic construct
  misc_feature 1..20: note = Antisense Sequence
  source 1..20: mol_type = other RNA
tcagaatacaagctccctta

SEQ ID NO: 358 - RNA, 20 nt, synthetic construct
  misc_feature 1..20: note = Antisense Sequence
  source 1..20: mol_type = other RNA
ttcagaatacaagctccctt

SEQ ID NO: 359 - RNA, 20 nt, synthetic construct
  misc_feature 1..20: note = Antisense Sequence
  source 1..20: mol_type = other RNA
attcagaatacaagctccct

SEQ ID NO: 360 - RNA, 20 nt, synthetic construct
  misc_feature 1..20: note = Antisense Sequence
  source 1..20: mol_type = other RNA
ctcccttagcatattcagaa

SEQ ID NO: 361 - RNA, 20 nt, synthetic construct
  misc_feature 1..20: note = Antisense Sequence
  source 1..20: mol_type = other RNA
actcccttagcatattcaga

SEQ ID NO: 362 - RNA, 20 nt, synthetic construct
  misc_feature 1..20: note = Antisense Sequence
  source 1..20: mol_type = other RNA
tgcttctggagatactgtac

SEQ ID NO: 363 - RNA, 20 nt, synthetic construct
  misc_feature 1..20: note = Antisense Sequence
  source 1..20: mol_type = other RNA
atgcttctggagatactgta

SEQ ID NO: 364 - RNA, 20 nt, synthetic construct
  misc_feature 1..20: note = Antisense Sequence
  source 1..20: mol_type = other RNA
tatgcttctggagatactgt

SEQ ID NO: 365 - RNA, 20 nt, synthetic construct
  misc_feature 1..20: note = Antisense Sequence
  source 1..20: mol_type = other RNA
atcccacaggtcctcgtttt

SEQ ID NO: 366 - RNA, 20 nt, synthetic construct
  misc_feature 1..20: note = Antisense Sequence
  source 1..20: mol_type = other RNA
tatcccacaggtcctcgttt

SEQ ID NO: 367 - RNA, 20 nt, synthetic construct
  misc_feature 1..20: note = Antisense Sequence
  source 1..20: mol_type = other RNA
ctatcccacaggtcctcgtt

SEQ ID NO: 368 - RNA, 20 nt, synthetic construct
  misc_feature 1..20: note = Antisense Sequence
  source 1..20: mol_type = other RNA
tactatcccacaggtcctcg

SEQ ID NO: 369 - RNA, 20 nt, synthetic construct
  misc_feature 1..20: note = Antisense Sequence
  source 1..20: mol_type = other RNA
atactatcccacaggtcctc

SEQ ID NO: 370 - RNA, 20 nt, synthetic construct
  misc_feature 1..20: note = Antisense Sequence
  source 1..20: mol_type = other RNA
ccatactatcccacaggtcc

SEQ ID NO: 371 - RNA, 20 nt, synthetic construct
  misc_feature 1..20: note = Antisense Sequence
  source 1..20: mol_type = other RNA
gccatactatcccacaggtc

SEQ ID NO: 372 - RNA, 20 nt, synthetic construct
  misc_feature 1..20: note = Antisense Sequence
  source 1..20: mol_type = other RNA
tgccatactatcccacaggt

SEQ ID NO: 373 - RNA, 20 nt, synthetic construct
  misc_feature 1..20: note = Antisense Sequence
  source 1..20: mol_type = other RNA
ttgccatactatcccacagg

SEQ ID NO: 374 - RNA, 20 nt, synthetic construct
  misc_feature 1..20: note = Antisense Sequence
  source 1..20: mol_type = other RNA
cttgccatactatcccacag

SEQ ID NO: 375 - RNA, 20 nt, synthetic construct
  misc_feature 1..20: note = Antisense Sequence
  source 1..20: mol_type = other RNA
acttgccatactatcccaca

SEQ ID NO: 376 - RNA, 20 nt, synthetic construct
  misc_feature 1..20: note = Antisense Sequence
  source 1..20: mol_type = other RNA
tacttgccatactatcccac

SEQ ID NO: 377 - RNA, 20 nt, synthetic construct
  misc_feature 1..20: note = Antisense Sequence
  source 1..20: mol_type = other RNA
atacttgccatactatccca

SEQ ID NO: 378 - RNA, 20 nt, synthetic construct
  misc_feature 1..20: note = Antisense Sequence
  source 1..20: mol_type = other RNA
aatacttgccatactatccc

SEQ ID NO: 379 - RNA, 20 nt, synthetic construct
  misc_feature 1..20: note = Antisense Sequence
  source 1..20: mol_type = other RNA
atctgtagggcaaatacttg

SEQ ID NO: 380 - RNA, 20 nt, synthetic construct
  misc_feature 1..20: note = Antisense Sequence
  source 1..20: mol_type = other RNA
catctgtagggcaaatactt

SEQ ID NO: 381 - RNA, 20 nt, synthetic construct
  misc_feature 1..20: note = Antisense Sequence
  source 1..20: mol_type = other RNA
ccatctgtagggcaaatact

SEQ ID NO: 382 - RNA, 20 nt, synthetic construct
  misc_feature 1..20: note = Antisense Sequence
  source 1..20: mol_type = other RNA
accatctgtagggcaaatac

SEQ ID NO: 383 - RNA, 20 nt, synthetic construct
  misc_feature 1..20: note = Antisense Sequence
  source 1..20: mol_type = other RNA
caccatctgtagggcaaata

SEQ ID NO: 384 - RNA, 20 nt, synthetic construct
  misc_feature 1..20: note = Antisense Sequence
  source 1..20: mol_type = other RNA
acaccatctgtagggcaaat

SEQ ID NO: 385 - RNA, 20 nt, synthetic construct
  misc_feature 1..20: note = Antisense Sequence
  source 1..20: mol_type = other RNA
atcccttttacaccatctgt

SEQ ID NO: 386 - RNA, 20 nt, synthetic construct
  misc_feature 1..20: note = Antisense Sequence
  source 1..20: mol_type = other RNA
atccatcccttttacaccat

SEQ ID NO: 387 - RNA, 20 nt, synthetic construct
  misc_feature 1..20: note = Antisense Sequence
  source 1..20: mol_type = other RNA
catccatcccttttacacca

SEQ ID NO: 388 - RNA, 20 nt, synthetic construct
  misc_feature 1..20: note = Antisense Sequence
  source 1..20: mol_type = other RNA
ccatccatcccttttacacc

SEQ ID NO: 389 - RNA, 20 nt, synthetic construct
  misc_feature 1..20: note = Antisense Sequence
  source 1..20: mol_type = other RNA
tagagcaaaagccatccatc

SEQ ID NO: 390 - RNA, 20 nt, synthetic construct
  misc_feature 1..20: note = Antisense Sequence
  source 1..20: mol_type = other RNA
ctagagcaaaagccatccat

SEQ ID NO: 391 - RNA, 20 nt, synthetic construct
  misc_feature 1..20: note = Antisense Sequence
  source 1..20: mol_type = other RNA
caatgtgaggatgaagatga

SEQ ID NO: 392 - RNA, 20 nt, synthetic construct
  misc_feature 1..20: note = Antisense Sequence
  source 1..20: mol_type = other RNA
ccaatgtgaggatgaagatg

SEQ ID NO: 393 - RNA, 20 nt, synthetic construct
  misc_feature 1..20: note = Antisense Sequence
  source 1..20: mol_type = other RNA
gccaatgtgaggatgaagat

SEQ ID NO: 394 - RNA, 20 nt, synthetic construct
  misc_feature 1..20: note = Antisense Sequence
  source 1..20: mol_type = other RNA
tgccaatgtgaggatgaaga

SEQ ID NO: 395 - RNA, 20 nt, synthetic construct
  misc_feature 1..20: note = Antisense Sequence
  source 1..20: mol_type = other RNA
atgccaatgtgaggatgaag

SEQ ID NO: 396 - RNA, 20 nt, synthetic construct
  misc_feature 1..20: note = Antisense Sequence
  source 1..20: mol_type = other RNA
gatgccaatgtgaggatgaa

SEQ ID NO: 397 - RNA, 20 nt, synthetic construct
  misc_feature 1..20: note = Antisense Sequence
  source 1..20: mol_type = other RNA
ctgatgccaatgtgaggatg

SEQ ID NO: 398 - RNA, 20 nt, synthetic construct
  misc_feature 1..20: note = Antisense Sequence
  source 1..20: mol_type = other RNA
cctgatgccaatgtgaggat

SEQ ID NO: 399 - RNA, 20 nt, synthetic construct
  misc_feature 1..20: note = Antisense Sequence
  source 1..20: mol_type = other RNA
tcatggttttcacatccacc

SEQ ID NO: 400 - RNA, 20 nt, synthetic construct
  misc_feature 1..20: note = Antisense Sequence
  source 1..20: mol_type = other RNA
atcatggttttcacatccac

SEQ ID NO: 401 - RNA, 20 nt, synthetic construct
  misc_feature 1..20: note = Antisense Sequence
  source 1..20: mol_type = other RNA
catcatggttttcacatcca

SEQ ID NO: 402 - RNA, 20 nt, synthetic construct
  misc_feature 1..20: note = Antisense Sequence
  source 1..20: mol_type = other RNA
tcatcatggttttcacatcc

SEQ ID NO: 403 - RNA, 20 nt, synthetic construct
  misc_feature 1..20: note = Antisense Sequence
  source 1..20: mol_type = other RNA
ccaagtgttcatcatggttt

SEQ ID NO: 404 - RNA, 20 nt, synthetic construct
  misc_feature 1..20: note = Antisense Sequence
  source 1..20: mol_type = other RNA
tccaagtgttcatcatggtt

SEQ ID NO: 405 - RNA, 20 nt, synthetic construct
  misc_feature 1..20: note = Antisense Sequence
  source 1..20: mol_type = other RNA
cactgtgatggttattaggg

SEQ ID NO: 406 - RNA, 20 nt, synthetic construct
  misc_feature 1..20: note = Antisense Sequence
  source 1..20: mol_type = other RNA
ctcactgtgatggttattag

SEQ ID NO: 407 - RNA, 20 nt, synthetic construct
  misc_feature 1..20: note = Antisense Sequence
  source 1..20: mol_type = other RNA
gtgctcttgcttcatgtgta

SEQ ID NO: 408 - RNA, 20 nt, synthetic construct
  misc_feature 1..20: note = Antisense Sequence
  source 1..20: mol_type = other RNA
agtgctcttgcttcatgtgt

SEQ ID NO: 409 - RNA, 20 nt, synthetic construct
  misc_feature 1..20: note = Antisense Sequence
  source 1..20: mol_type = other RNA
tagtgctcttgcttcatgtg

SEQ ID NO: 410 - RNA, 20 nt, synthetic construct
  misc_feature 1..20: note = Antisense Sequence
  source 1..20: mol_type = other RNA
gtagtgctcttgcttcatgt

SEQ ID NO: 411 - RNA, 20 nt, synthetic construct
  misc_feature 1..20: note = Antisense Sequence
  source 1..20: mol_type = other RNA
tgtagtgctcttgcttcatg

SEQ ID NO: 412 - RNA, 20 nt, synthetic construct
  misc_feature 1..20: note = Antisense Sequence
  source 1..20: mol_type = other RNA
atgtagtgctcttgcttcat

SEQ ID NO: 413 - RNA, 20 nt, synthetic construct
  misc_feature 1..20: note = Antisense Sequence
  source 1..20: mol_type = other RNA
catgtagtgctcttgcttca

SEQ ID NO: 414 - RNA, 20 nt, synthetic construct
  misc_feature 1..20: note = Antisense Sequence
  source 1..20: mol_type = other RNA
ccttcatgtagtgctcttgc

SEQ ID NO: 415 - RNA, 20 nt, synthetic construct
  misc_feature 1..20: note = Antisense Sequence
  source 1..20: mol_type = other RNA
cccttcatgtagtgctcttg

SEQ ID NO: 416 - RNA, 20 nt, synthetic construct
  misc_feature 1..20: note = Antisense Sequence
  source 1..20: mol_type = other RNA
gcccttcatgtagtgctctt

SEQ ID NO: 417 - RNA, 20 nt, synthetic construct
  misc_feature 1..20: note = Antisense Sequence
  source 1..20: mol_type = other RNA
agcccttcatgtagtgctct

SEQ ID NO: 418 - RNA, 20 nt, synthetic construct
  misc_feature 1..20: note = Antisense Sequence
  source 1..20: mol_type = other RNA
agagcccttcatgtagtgct

SEQ ID NO: 419 - RNA, 20 nt, synthetic construct
  misc_feature 1..20: note = Antisense Sequence
  source 1..20: mol_type = other RNA
cagagcccttcatgtagtgc

SEQ ID NO: 420 - RNA, 20 nt, synthetic construct
  misc_feature 1..20: note = Antisense Sequence
  source 1..20: mol_type = other RNA
tcagagcccttcatgtagtg

SEQ ID NO: 421 - RNA, 20 nt, synthetic construct
  misc_feature 1..20: note = Antisense Sequence
  source 1..20: mol_type = other RNA
cgtcagagcccttcatgtag

SEQ ID NO: 422 - RNA, 20 nt, synthetic construct
  misc_feature 1..20: note = Antisense Sequence
  source 1..20: mol_type = other RNA
ccgtcagagcccttcatgta

SEQ ID NO: 423 - RNA, 20 nt, synthetic construct
  misc_feature 1..20: note = Antisense Sequence
  source 1..20: mol_type = other RNA
atggaacatgccacaggtac

SEQ ID NO: 424 - RNA, 20 nt, synthetic construct
  misc_feature 1..20: note = Antisense Sequence
  source 1..20: mol_type = other RNA
aatggaacatgccacaggta

SEQ ID NO: 425 - RNA, 20 nt, synthetic construct
  misc_feature 1..20: note = Antisense Sequence
  source 1..20: mol_type = other RNA
caatggaacatgccacaggt

SEQ ID NO: 426 - RNA, 20 nt, synthetic construct
  misc_feature 1..20: note = Antisense Sequence
  source 1..20: mol_type = other RNA
tcaatggaacatgccacagg

SEQ ID NO: 427 - RNA, 20 nt, synthetic construct
  misc_feature 1..20: note = Antisense Sequence
  source 1..20: mol_type = other RNA
gtcaatggaacatgccacag

SEQ ID NO: 428 - RNA, 20 nt, synthetic construct
  misc_feature 1..20: note = Antisense Sequence
  source 1..20: mol_type = other RNA
tgtcaatggaacatgccaca

SEQ ID NO: 429 - RNA, 20 nt, synthetic construct
  misc_feature 1..20: note = Antisense Sequence
  source 1..20: mol_type = other RNA
ttgctggtgatgaatgtcaa

SEQ ID NO: 430 - RNA, 20 nt, synthetic construct
  misc_feature 1..20: note = Antisense Sequence
  source 1..20: mol_type = other RNA
ccattccacctcttctggga

SEQ ID NO: 431 - RNA, 20 nt, synthetic construct
  misc_feature 1..20: note = Antisense Sequence
  source 1..20: mol_type = other RNA
aatttgatccattccacctc

SEQ ID NO: 432 - RNA, 20 nt, synthetic construct
  misc_feature 1..20: note = Antisense Sequence
  source 1..20: mol_type = other RNA
ccattcatgcccacattaaa

SEQ ID NO: 433 - RNA, 20 nt, synthetic construct
  misc_feature 1..20: note = Antisense Sequence
  source 1..20: mol_type = other RNA
gccattcatgcccacattaa

SEQ ID NO: 434 - RNA, 20 nt, synthetic construct
  misc_feature 1..20: note = Antisense Sequence
  source 1..20: mol_type = other RNA
agccattcatgcccacatta

SEQ ID NO: 435 - RNA, 20 nt, synthetic construct
  misc_feature 1..20: note = Antisense Sequence
  source 1..20: mol_type = other RNA
tagccattcatgcccacatt

SEQ ID NO: 436 - RNA, 20 nt, synthetic construct
  misc_feature 1..20: note = Antisense Sequence
  source 1..20: mol_type = other RNA
atagccattcatgcccacat

SEQ ID NO: 437 - RNA, 20 nt, synthetic construct
  misc_feature 1..20: note = Antisense Sequence
  source 1..20: mol_type = other RNA
gtaatagccattcatgccca

SEQ ID NO: 438 - RNA, 20 nt, synthetic construct
  misc_feature 1..20: note = Antisense Sequence
  source 1..20: mol_type = other RNA
tcctcgtaatgcacaatgta

SEQ ID NO: 439 - RNA, 20 nt, synthetic construct
  misc_feature 1..20: note = Antisense Sequence
  source 1..20: mol_type = other RNA
atcctcgtaatgcacaatgt

SEQ ID NO: 440 - RNA, 20 nt, synthetic construct
  misc_feature 1..20: note = Antisense Sequence
  source 1..20: mol_type = other RNA
catcctcgtaatgcacaatg

SEQ ID NO: 441 - RNA, 20 nt, synthetic construct
  misc_feature 1..20: note = Antisense Sequence
  source 1..20: mol_type = other RNA
tcatcctcgtaatgcacaat

SEQ ID NO: 442 - RNA, 20 nt, synthetic construct
  misc_feature 1..20: note = Antisense Sequence
  source 1..20: mol_type = other RNA
atcatcctcgtaatgcacaa

SEQ ID NO: 443 - RNA, 20 nt, synthetic construct
  misc_feature 1..20: note = Antisense Sequence
  source 1..20: mol_type = other RNA
catcatcctcgtaatgcaca

SEQ ID NO: 444 - RNA, 20 nt, synthetic construct
  misc_feature 1..20: note = Antisense Sequence
  source 1..20: mol_type = other RNA
ccatcatcctcgtaatgcac

SEQ ID NO: 445 - RNA, 20 nt, synthetic construct
  misc_feature 1..20: note = Antisense Sequence
  source 1..20: mol_type = other RNA
tccatcatcctcgtaatgca

SEQ ID NO: 446 - RNA, 20 nt, synthetic construct
  misc_feature 1..20: note = Antisense Sequence
  source 1..20: mol_type = other RNA
atccatcatcctcgtaatgc

SEQ ID NO: 447 - RNA, 20 nt, synthetic construct
  misc_feature 1..20: note = Antisense Sequence
  source 1..20: mol_type = other RNA
catccatcatcctcgtaatg

SEQ ID NO: 448 - RNA, 20 nt, synthetic construct
  misc_feature 1..20: note = Antisense Sequence
  source 1..20: mol_type = other RNA
ccatccatcatcctcgtaat

SEQ ID NO: 449 - RNA, 20 nt, synthetic construct
  misc_feature 1..20: note = Antisense Sequence
  source 1..20: mol_type = other RNA
cccatccatcatcctcgtaa

SEQ ID NO: 450 - RNA, 20 nt, synthetic construct
  misc_feature 1..20: note = Antisense Sequence
  source 1..20: mol_type = other RNA
gtcccatccatcatcctcgt

SEQ ID NO: 451 - RNA, 20 nt, synthetic construct
  misc_feature 1..20: note = Antisense Sequence
  source 1..20: mol_type = other RNA
agtcccatccatcatcctcg

SEQ ID NO: 452 - RNA, 20 nt, synthetic construct
  misc_feature 1..20: note = Antisense Sequence
  source 1..20: mol_type = other RNA
gagtcccatccatcatcctc

SEQ ID NO: 453 - RNA, 20 nt, synthetic construct
  misc_feature 1..20: note = Antisense Sequence
  source 1..20: mol_type = other RNA
caaagagtcccatccatcat

SEQ ID NO: 454 - RNA, 20 nt, synthetic construct
  misc_feature 1..20: note = Antisense Sequence
  source 1..20: mol_type = other RNA
tcaaagagtcccatccatca

SEQ ID NO: 455 - RNA, 20 nt, synthetic construct
  misc_feature 1..20: note = Antisense Sequence
  source 1..20: mol_type = other RNA
agtcaaagagtcccatccat

SEQ ID NO: 456 - RNA, 20 nt, synthetic construct
  misc_feature 1..20: note = Antisense Sequence
  source 1..20: mol_type = other RNA
cagtcaaagagtcccatcca

SEQ ID NO: 457 - RNA, 20 nt, synthetic construct
  misc_feature 1..20: note = Antisense Sequence
  source 1..20: mol_type = other RNA
ccagtcaaagagtcccatcc

SEQ ID NO: 458 - RNA, 20 nt, synthetic construct
  misc_feature 1..20: note = Antisense Sequence
  source 1..20: mol_type = other RNA
gccagtcaaagagtcccatc

SEQ ID NO: 459 - RNA, 20 nt, synthetic construct
  misc_feature 1..20: note = Antisense Sequence
  source 1..20: mol_type = other RNA
ggccagtcaaagagtcccat

SEQ ID NO: 460 - RNA, 20 nt, synthetic construct
  misc_feature 1..20: note = Antisense Sequence
  source 1..20: mol_type = other RNA
aggccagtcaaagagtccca

SEQ ID NO: 461 - RNA, 20 nt, synthetic construct
  misc_feature 1..20: note = Antisense Sequence
  source 1..20: mol_type = other RNA
aaggccagtcaaagagtccc

SEQ ID NO: 462 - RNA, 20 nt, synthetic construct
  misc_feature 1..20: note = Antisense Sequence
  source 1..20: mol_type = other RNA
aaaggccagtcaaagagtcc

SEQ ID NO: 463 - RNA, 20 nt, synthetic construct
  misc_feature 1..20: note = Antisense Sequence
  source 1..20: mol_type = other RNA
taaaaggccagtcaaagagt

SEQ ID NO: 464 - RNA, 20 nt, synthetic construct
  misc_feature 1..20: note = Antisense Sequence
  source 1..20: mol_type = other RNA
ttaaaaggccagtcaaagag

SEQ ID NO: 465 - RNA, 20 nt, synthetic construct
  misc_feature 1..20: note = Antisense Sequence
  source 1..20: mol_type = other RNA
ttactgctgactgctgtgtg

SEQ ID NO: 466 - RNA, 20 nt, synthetic construct
  misc_feature 1..20: note = Antisense Sequence
  source 1..20: mol_type = other RNA
cattactgctgactgctgtg

SEQ ID NO: 467 - RNA, 20 nt, synthetic construct
  misc_feature 1..20: note = Antisense Sequence
  source 1..20: mol_type = other RNA
tcattactgctgactgctgt

SEQ ID NO: 468 - RNA, 20 nt, synthetic construct
  misc_feature 1..20: note = Antisense Sequence
  source 1..20: mol_type = other RNA
atcattactgctgactgctg

SEQ ID NO: 469 - RNA, 20 nt, synthetic construct
  misc_feature 1..20: note = Antisense Sequence
  source 1..20: mol_type = other RNA
gatcattactgctgactgct

SEQ ID NO: 470 - RNA, 20 nt, synthetic construct
  misc_feature 1..20: note = Antisense Sequence
  source 1..20: mol_type = other RNA
cgatcattactgctgactgc

SEQ ID NO: 471 - RNA, 20 nt, synthetic construct
  misc_feature 1..20: note = Antisense Sequence
  source 1..20: mol_type = other RNA
ccgatcattactgctgactg

SEQ ID NO: 472 - RNA, 20 nt, synthetic construct
  misc_feature 1..20: note = Antisense Sequence
  source 1..20: mol_type = other RNA
tcaatggacagcttcccaat

SEQ ID NO: 473 - RNA, 20 nt, synthetic construct
  misc_feature 1..20: note = Antisense Sequence
  source 1..20: mol_type = other RNA
ttcaatggacagcttcccaa

SEQ ID NO: 474 - RNA, 20 nt, synthetic construct
  misc_feature 1..20: note = Antisense Sequence
  source 1..20: mol_type = other RNA
ttttcaatggacagcttccc

SEQ ID NO: 475 - RNA, 20 nt, synthetic construct
  misc_feature 1..20: note = Antisense Sequence
  source 1..20: mol_type = other RNA
cttttcaatggacagcttcc

SEQ ID NO: 476 - RNA, 20 nt, synthetic construct
  misc_feature 1..20: note = Antisense Sequence
  source 1..20: mol_type = other RNA
tacagggataaatccaaggc

SEQ ID NO: 477 - RNA, 20 nt, synthetic construct
  misc_feature 1..20: note = Antisense Sequence
  source 1..20: mol_type = other RNA
gtacagggataaatccaagg

SEQ ID NO: 478 - RNA, 20 nt, synthetic construct
  misc_feature 1..20: note = Antisense Sequence
  source 1..20: mol_type = other RNA
agtacagggataaatccaag

SEQ ID NO: 479 - RNA, 20 nt, synthetic construct
  misc_feature 1..20: note = Antisense Sequence
  source 1..20: mol_type = other RNA
caagtacagggataaatcca

SEQ ID NO: 480 - RNA, 20 nt, synthetic construct
  misc_feature 1..20: note = Antisense Sequence
  source 1..20: mol_type = other RNA
tcaagtacagggataaatcc

SEQ ID NO: 481 - RNA, 20 nt, synthetic construct
  misc_feature 1..20: note = Antisense Sequence
  source 1..20: mol_type = other RNA
cgggcataatttcagtttca

SEQ ID NO: 482 - RNA, 20 nt, synthetic construct
  misc_feature 1..20: note = Antisense Sequence
  source 1..20: mol_type = other RNA
acgggcataatttcagtttc

SEQ ID NO: 483 - RNA, 20 nt, synthetic construct
  misc_feature 1..20: note = Antisense Sequence
  source 1..20: mol_type = other RNA
cacgggcataatttcagttt

SEQ ID NO: 484 - RNA, 20 nt, synthetic construct
  misc_feature 1..20: note = Antisense Sequence
  source 1..20: mol_type = other RNA
acacgggcataatttcagtt

SEQ ID NO: 485 - RNA, 20 nt, synthetic construct
  misc_feature 1..20: note = Antisense Sequence
  source 1..20: mol_type = other RNA
aacacgggcataatttcagt

SEQ ID NO: 486 - RNA, 20 nt, synthetic construct
  misc_feature 1..20: note = Antisense Sequence
  source 1..20: mol_type = other RNA
aaacacgggcataatttcag

SEQ ID NO: 487 - RNA, 20 nt, synthetic construct
  misc_feature 1..20: note = Antisense Sequence
  source 1..20: mol_type = other RNA
cttgaaacacgggcataatt

SEQ ID NO: 488 - RNA, 20 nt, synthetic construct
  misc_feature 1..20: note = Antisense Sequence
  source 1..20: mol_type = other RNA
ccttgaaacacgggcataat

SEQ ID NO: 489 - RNA, 20 nt, synthetic construct
  misc_feature 1..20: note = Antisense Sequence
  source 1..20: mol_type = other RNA
accttgaaacacgggcataa

SEQ ID NO: 490 - RNA, 20 nt, synthetic construct
  misc_feature 1..20: note = Antisense Sequence
  source 1..20: mol_type = other RNA
aaccttgaaacacgggcata

SEQ ID NO: 491 - RNA, 20 nt, synthetic construct
  misc_feature 1..20: note = Antisense Sequence
  source 1..20: mol_type = other RNA
aaaccttgaaacacgggcat

SEQ ID NO: 492 - RNA, 20 nt, synthetic construct
  misc_feature 1..20: note = Antisense Sequence
  source 1..20: mol_type = other RNA
caaaccttgaaacacgggca

SEQ ID NO: 493 - RNA, 20 nt, synthetic construct
  misc_feature 1..20: note = Antisense Sequence
  source 1..20: mol_type = other RNA
ccttgaattgagtttccact

SEQ ID NO: 494 - RNA, 20 nt, synthetic construct
  misc_feature 1..20: note = Antisense Sequence
  source 1..20: mol_type = other RNA
gccttgaattgagtttccac

SEQ ID NO: 495 - RNA, 20 nt, synthetic construct
  misc_feature 1..20: note = Antisense Sequence
  source 1..20: mol_type = other RNA
ggccttgaattgagtttcca

SEQ ID NO: 496 - RNA, 20 nt, synthetic construct
  misc_feature 1..20: note = Antisense Sequence
  source 1..20: mol_type = other RNA
ttagcagcctgatgaggaag

SEQ ID NO: 497 - RNA, 20 nt, synthetic construct
  misc_feature 1..20: note = Antisense Sequence
  source 1..20: mol_type = other RNA
gaggtcccttagcagcctga

SEQ ID NO: 498 - RNA, 20 nt, synthetic construct
  misc_feature 1..20: note = Antisense Sequence
  source 1..20: mol_type = other RNA
atgaggtcccttagcagcct

SEQ ID NO: 499 - RNA, 20 nt, synthetic construct
  misc_feature 1..20: note = Antisense Sequence
  source 1..20: mol_type = other RNA
tcaatgaggtcccttagcag

SEQ ID NO: 500 - RNA, 20 nt, synthetic construct
  misc_feature 1..20: note = Antisense Sequence
  source 1..20: mol_type = other RNA
atcaatgaggtcccttagca

SEQ ID NO: 501 - RNA, 20 nt, synthetic construct
  misc_feature 1..20: note = Antisense Sequence
  source 1..20: mol_type = other RNA
tatcaatgaggtcccttagc

SEQ ID NO: 502 - RNA, 20 nt, synthetic construct
  misc_feature 1..20: note = Antisense Sequence
  source 1..20: mol_type = other RNA
ttatcaatgaggtcccttag

SEQ ID NO: 503 - RNA, 20 nt, synthetic construct
  misc_feature 1..20: note = Antisense Sequence
  source 1..20: mol_type = other RNA
tgcttatcaatgaggtccct

SEQ ID NO: 504 - RNA, 20 nt, synthetic construct
  misc_feature 1..20: note = Antisense Sequence
  source 1..20: mol_type = other RNA
ctgcttatcaatgaggtccc

SEQ ID NO: 505 - RNA, 20 nt, synthetic construct
  misc_feature 1..20: note = Antisense Sequence
  source 1..20: mol_type = other RNA
tctgcttatcaatgaggtcc

SEQ ID NO: 506 - RNA, 20 nt, synthetic construct
  misc_feature 1..20: note = Antisense Sequence
  source 1..20: mol_type = other RNA
gtctgcttatcaatgaggtc

SEQ ID NO: 507 - RNA, 20 nt, synthetic construct
  misc_feature 1..20: note = Antisense Sequence
  source 1..20: mol_type = other RNA
tgtctgcttatcaatgaggt

SEQ ID NO: 508 - RNA, 20 nt, synthetic construct
  misc_feature 1..20: note = Antisense Sequence
  source 1..20: mol_type = other RNA
catgtctgcttatcaatgag

SEQ ID NO: 509 - RNA, 20 nt, synthetic construct
  misc_feature 1..20: note = Antisense Sequence
  source 1..20: mol_type = other RNA
ctgtccatgtctgcttatca

SEQ ID NO: 510 - RNA, 20 nt, synthetic construct
  misc_feature 1..20: note = Antisense Sequence
  source 1..20: mol_type = other RNA
tctgtccatgtctgcttatc

SEQ ID NO: 511 - RNA, 20 nt, synthetic construct
  misc_feature 1..20: note = Antisense Sequence
  source 1..20: mol_type = other RNA
tcgtctgtccatgtctgctt

SEQ ID NO: 512 - RNA, 20 nt, synthetic construct
  misc_feature 1..20: note = Antisense Sequence
  source 1..20: mol_type = other RNA
ctcgtctgtccatgtctgct

SEQ ID NO: 513 - RNA, 20 nt, synthetic construct
  misc_feature 1..20: note = Antisense Sequence
  source 1..20: mol_type = other RNA
gccctcgtctgtccatgtct

SEQ ID NO: 514 - RNA, 20 nt, synthetic construct
  misc_feature 1..20: note = Antisense Sequence
  source 1..20: mol_type = other RNA
agccctcgtctgtccatgtc

SEQ ID NO: 515 - RNA, 20 nt, synthetic construct
  misc_feature 1..20: note = Antisense Sequence
  source 1..20: mol_type = other RNA
gagccctcgtctgtccatgt

SEQ ID NO: 516 - RNA, 20 nt, synthetic construct
  misc_feature 1..20: note = Antisense Sequence
  source 1..20: mol_type = other RNA
ctgagccctcgtctgtccat

SEQ ID NO: 517 - RNA, 20 nt, synthetic construct
  misc_feature 1..20: note = Antisense Sequence
  source 1..20: mol_type = other RNA
actgagccctcgtctgtcca

SEQ ID NO: 518 - RNA, 20 nt, synthetic construct
  misc_feature 1..20: note = Antisense Sequence
  source 1..20: mol_type = other RNA
acaggcgaggagtagtagtt

SEQ ID NO: 519 - RNA, 20 nt, synthetic construct
  misc_feature 1..20: note = Antisense Sequence
  source 1..20: mol_type = other RNA
cacaggcgaggagtagtagt

SEQ ID NO: 520 - RNA, 20 nt, synthetic construct
  misc_feature 1..20: note = Antisense Sequence
  source 1..20: mol_type = other RNA
acacaggcgaggagtagtag

SEQ ID NO: 521 - RNA, 20 nt, synthetic construct
  misc_feature 1..20: note = Antisense Sequence
  source 1..20: mol_type = other RNA
cacacaggcgaggagtagta

SEQ ID NO: 522 - RNA, 20 nt, synthetic construct
  misc_feature 1..20: note = Antisense Sequence
  source 1..20: mol_type = other RNA
gcacacaggcgaggagtagt

SEQ ID NO: 523 - RNA, 20 nt, synthetic construct
  misc_feature 1..20: note = Antisense Sequence
  source 1..20: mol_type = other RNA
tgcacacaggcgaggagtag

SEQ ID NO: 524 - RNA, 20 nt, synthetic construct
  misc_feature 1..20: note = Antisense Sequence
  source 1..20: mol_type = other RNA
tagccttctgccctctgtac

SEQ ID NO: 525 - RNA, 20 nt, synthetic construct
  misc_feature 1..20: note = Antisense Sequence
  source 1..20: mol_type = other RNA
aaatagccttctgccctctg

SEQ ID NO: 526 - RNA, 20 nt, synthetic construct
  misc_feature 1..20: note = Antisense Sequence
  source 1..20: mol_type = other RNA
gaaatagccttctgccctct

SEQ ID NO: 527 - RNA, 20 nt, synthetic construct
  misc_feature 1..20: note = Antisense Sequence
  source 1..20: mol_type = other RNA
ctgaaatagccttctgccct

SEQ ID NO: 528 - RNA, 20 nt, synthetic construct
  misc_feature 1..20: note = Antisense Sequence
  source 1..20: mol_type = other RNA
tttctgaaatagccttctgc

SEQ ID NO: 529 - RNA, 20 nt, synthetic construct
  misc_feature 1..20: note = Antisense Sequence
  source 1..20: mol_type = other RNA
ttccactttctgaaatagcc

SEQ ID NO: 530 - RNA, 20 nt, synthetic construct
  misc_feature 1..20: note = Antisense Sequence
  source 1..20: mol_type = other RNA
gctcaagtttccattggatt

SEQ ID NO: 531 - RNA, 20 nt, synthetic construct
  misc_feature 1..20: note = Antisense Sequence
  source 1..20: mol_type = other RNA
ggctcaagtttccattggat

SEQ ID NO: 532 - RNA, 20 nt, synthetic construct
  misc_feature 1..20: note = Antisense Sequence
  source 1..20: mol_type = other RNA
aggctcaagtttccattgga

SEQ ID NO: 533 - RNA, 20 nt, synthetic construct
  misc_feature 1..20: note = Antisense Sequence
  source 1..20: mol_type = other RNA
cactgccaaggtcacgtcga

SEQ ID NO: 534 - RNA, 20 nt, synthetic construct
  misc_feature 1..20: note = Antisense Sequence
  source 1..20: mol_type = other RNA
acactgccaaggtcacgtcg

SEQ ID NO: 535 - RNA, 20 nt, synthetic construct
  misc_feature 1..20: note = Antisense Sequence
  source 1..20: mol_type = other RNA
aacactgccaaggtcacgtc

SEQ ID NO: 536 - RNA, 20 nt, synthetic construct
  misc_feature 1..20: note = Antisense Sequence
  source 1..20: mol_type = other RNA
aaacactgccaaggtcacgt

SEQ ID NO: 537 - RNA, 20 nt, synthetic construct
  misc_feature 1..20: note = Antisense Sequence
  source 1..20: mol_type = other RNA
cagcaaacactgccaaggtc

SEQ ID NO: 538 - RNA, 20 nt, synthetic construct
  misc_feature 1..20: note = Antisense Sequence
  source 1..20: mol_type = other RNA
ccacagcaaacactgccaag

SEQ ID NO: 539 - RNA, 20 nt, synthetic construct
  misc_feature 1..20: note = Antisense Sequence
  source 1..20: mol_type = other RNA
taaagaaaatcccagccttc

SEQ ID NO: 540 - RNA, 20 nt, synthetic construct
  misc_feature 1..20: note = Antisense Sequence
  source 1..20: mol_type = other RNA
gtactggacaaagaaaactg

SEQ ID NO: 541 - RNA, 20 nt, synthetic construct
  misc_feature 1..20: note = Antisense Sequence
  source 1..20: mol_type = other RNA
tgcagagggcaaattcaatt

SEQ ID NO: 542 - RNA, 20 nt, synthetic construct
  misc_feature 1..20: note = Antisense Sequence
  source 1..20: mol_type = other RNA
atctagtagccattgaagct

SEQ ID NO: 543 - RNA, 20 nt, synthetic construct
  misc_feature 1..20: note = Antisense Sequence
  source 1..20: mol_type = other RNA
catctagtagccattgaagc

SEQ ID NO: 544 - RNA, 20 nt, synthetic construct
  misc_feature 1..20: note = Antisense Sequence
  source 1..20: mol_type = other RNA
tcatctagtagccattgaag

SEQ ID NO: 545 - RNA, 20 nt, synthetic construct
  misc_feature 1..20: note = Antisense Sequence
  source 1..20: mol_type = other RNA
ctttcatctagtagccattg

SEQ ID NO: 546 - RNA, 20 nt, synthetic construct
  misc_feature 1..20: note = Antisense Sequence
  source 1..20: mol_type = other RNA
gctttcatctagtagccatt

SEQ ID NO: 547 - RNA, 20 nt, synthetic construct
  misc_feature 1..20: note = Antisense Sequence
  source 1..20: mol_type = other RNA
agctttcatctagtagccat

SEQ ID NO: 548 - RNA, 20 nt, synthetic construct
  misc_feature 1..20: note = Antisense Sequence
  source 1..20: mol_type = other RNA
ctgccaatgagtgtaagaat

SEQ ID NO: 549 - RNA, 20 nt, synthetic construct
  misc_feature 1..20: note = Antisense Sequence
  source 1..20: mol_type = other RNA
cctgccaatgagtgtaagaa

SEQ ID NO: 550 - RNA, 20 nt, synthetic construct
  misc_feature 1..20: note = Antisense Sequence
  source 1..20: mol_type = other RNA
tcctgccaatgagtgtaaga

SEQ ID NO: 551 - RNA, 20 nt, synthetic construct
  misc_feature 1..20: note = Antisense Sequence
  source 1..20: mol_type = other RNA
ttcctgccaatgagtgtaag

SEQ ID NO: 552 - RNA, 20 nt, synthetic construct
  misc_feature 1..20: note = Antisense Sequence
  source 1..20: mol_type = other RNA
gttcctgccaatgagtgtaa

SEQ ID NO: 553 - RNA, 20 nt, synthetic construct
  misc_feature 1..20: note = Antisense Sequence
  source 1..20: mol_type = other RNA
ggttcctgccaatgagtgta

SEQ ID NO: 554 - RNA, 20 nt, synthetic construct
  misc_feature 1..20: note = Antisense Sequence
  source 1..20: mol_type = other RNA
gggttcctgccaatgagtgt

SEQ ID NO: 555 - RNA, 20 nt, synthetic construct
  misc_feature 1..20: note = Antisense Sequence
  source 1..20: mol_type = other RNA
tgggttcctgccaatgagtg

SEQ ID NO: 556 - RNA, 20 nt, synthetic construct
  misc_feature 1..20: note = Antisense Sequence
  source 1..20: mol_type = other RNA
tactgggttcctgccaatga

SEQ ID NO: 557 - RNA, 20 nt, synthetic construct
  misc_feature 1..20: note = Antisense Sequence
  source 1..20: mol_type = other RNA
atcctactgggttcctgcca

SEQ ID NO: 558 - RNA, 20 nt, synthetic construct
  misc_feature 1..20: note = Antisense Sequence
  source 1..20: mol_type = other RNA
tatcctactgggttcctgcc

SEQ ID NO: 559 - RNA, 20 nt, synthetic construct
  misc_feature 1..20: note = Antisense Sequence
  source 1..20: mol_type = other RNA
gtatcctactgggttcctgc

SEQ ID NO: 560 - RNA, 20 nt, synthetic construct
  misc_feature 1..20: note = Antisense Sequence
  source 1..20: mol_type = other RNA
ggtatcctactgggttcctg

SEQ ID NO: 561 - RNA, 20 nt, synthetic construct
  misc_feature 1..20: note = Antisense Sequence
  source 1..20: mol_type = other RNA
gggtatcctactgggttcct

SEQ ID NO: 562 - RNA, 20 nt, synthetic construct
  misc_feature 1..20: note = Antisense Sequence
  source 1..20: mol_type = other RNA
tgggtatcctactgggttcc

SEQ ID NO: 563 - RNA, 20 nt, synthetic construct
  misc_feature 1..20: note = Antisense Sequence
  source 1..20: mol_type = other RNA
tcctcagaaattgccaggcc

SEQ ID NO: 564 - RNA, 20 nt, synthetic construct
  misc_feature 1..20: note = Antisense Sequence
  source 1..20: mol_type = other RNA
ttcctcagaaattgccaggc

SEQ ID NO: 565 - RNA, 20 nt, synthetic construct
  misc_feature 1..20: note = Antisense Sequence
  source 1..20: mol_type = other RNA
agatgagccaagttcaaact

SEQ ID NO: 566 - RNA, 20 nt, synthetic construct
  misc_feature 1..20: note = Antisense Sequence
  source 1..20: mol_type = other RNA
aagatgagccaagttcaaac

SEQ ID NO: 567 - RNA, 20 nt, synthetic construct
  misc_feature 1..20: note = Antisense Sequence
  source 1..20: mol_type = other RNA
gaagatgagccaagttcaaa

SEQ ID NO: 568 - RNA, 20 nt, synthetic construct
  misc_feature 1..20: note = Antisense Sequence
  source 1..20: mol_type = other RNA
ggaagatgagccaagttcaa

SEQ ID NO: 569 - RNA, 20 nt, synthetic construct
  misc_feature 1..20: note = Antisense Sequence
  source 1..20: mol_type = other RNA
tggaagatgagccaagttca

SEQ ID NO: 570 - RNA, 20 nt, synthetic construct
  misc_feature 1..20: note = Antisense Sequence
  source 1..20: mol_type = other RNA
atggaagatgagccaagttc

SEQ ID NO: 571 - RNA, 20 nt, synthetic construct
  misc_feature 1..20: note = Antisense Sequence
  source 1..20: mol_type = other RNA
tgtgggctatggaagatgag

SEQ ID NO: 572 - RNA, 20 nt, synthetic construct
  misc_feature 1..20: note = Antisense Sequence
  source 1..20: mol_type = other RNA
ccattaccatgtgggctatg

SEQ ID NO: 573 - RNA, 20 nt, synthetic construct
  misc_feature 1..20: note = Antisense Sequence
  source 1..20: mol_type = other RNA
gttgtacccattaccatgtg

SEQ ID NO: 574 - RNA, 20 nt, synthetic construct
  misc_feature 1..20: note = Antisense Sequence
  source 1..20: mol_type = other RNA
tgttgtacccattaccatgt

SEQ ID NO: 575 - RNA, 20 nt, synthetic construct
  misc_feature 1..20: note = Antisense Sequence
  source 1..20: mol_type = other RNA
ttgttgtacccattaccatg

SEQ ID NO: 576 - RNA, 20 nt, synthetic construct
  misc_feature 1..20: note = Antisense Sequence
  source 1..20: mol_type = other RNA
aagccgtgttcttgtggaga

SEQ ID NO: 577 - RNA, 20 nt, synthetic construct
  misc_feature 1..20: note = Antisense Sequence
  source 1..20: mol_type = other RNA
cctcttcaagccgtgttctt

SEQ ID NO: 578 - RNA, 20 nt, synthetic construct
  misc_feature 1..20: note = Antisense Sequence
  source 1..20: mol_type = other RNA
acctcttcaagccgtgttct

SEQ ID NO: 579 - RNA, 20 nt, synthetic construct
  misc_feature 1..20: note = Antisense Sequence
  source 1..20: mol_type = other RNA
tacctcttcaagccgtgttc

SEQ ID NO: 580 - RNA, 20 nt, synthetic construct
  misc_feature 1..20: note = Antisense Sequence
  source 1..20: mol_type = other RNA
ttacctcttcaagccgtgtt

SEQ ID NO: 581 - RNA, 20 nt, synthetic construct
  misc_feature 1..20: note = Antisense Sequence
  source 1..20: mol_type = other RNA
tttacctcttcaagccgtgt

SEQ ID NO: 582 - RNA, 20 nt, synthetic construct
  misc_feature 1..20: note = Antisense Sequence
  source 1..20: mol_type = other RNA
ttttacctcttcaagccgtg

SEQ ID NO: 583 - RNA, 20 nt, synthetic construct
  misc_feature 1..20: note = Antisense Sequence
  source 1..20: mol_type = other RNA
cttttacctcttcaagccgt

SEQ ID NO: 584 - RNA, 20 nt, synthetic construct
  misc_feature 1..20: note = Antisense Sequence
  source 1..20: mol_type = other RNA
ccttttacctcttcaagccg

SEQ ID NO: 585 - RNA, 20 nt, synthetic construct
  misc_feature 1..20: note = Antisense Sequence
  source 1..20: mol_type = other RNA
atccttttacctcttcaagc

SEQ ID NO: 586 - RNA, 20 nt, synthetic construct
  misc_feature 1..20: note = Antisense Sequence
  source 1..20: mol_type = other RNA
ctgaagaatccttttacctc

SEQ ID NO: 587 - RNA, 20 nt, synthetic construct
  misc_feature 1..20: note = Antisense Sequence
  source 1..20: mol_type = other RNA
gctgaagaatccttttacct

SEQ ID NO: 588 - RNA, 20 nt, synthetic construct
  misc_feature 1..20: note = Antisense Sequence
  source 1..20: mol_type = other RNA
agctgaagaatccttttacc

SEQ ID NO: 589 - RNA, 20 nt, synthetic construct
  misc_feature 1..20: note = Antisense Sequence
  source 1..20: mol_type = other RNA
acggagctgagaaccatttt

SEQ ID NO: 590 - RNA, 20 nt, synthetic construct
  misc_feature 1..20: note = Antisense Sequence
  source 1..20: mol_type = other RNA
aacggagctgagaaccattt

SEQ ID NO: 591 - RNA, 20 nt, synthetic construct
  misc_feature 1..20: note = Antisense Sequence
  source 1..20: mol_type = other RNA
caacggagctgagaaccatt

SEQ ID NO: 592 - RNA, 20 nt, synthetic construct
  misc_feature 1..20: note = Antisense Sequence
  source 1..20: mol_type = other RNA
acaacggagctgagaaccat

SEQ ID NO: 593 - RNA, 20 nt, synthetic construct
  misc_feature 1..20: note = Antisense Sequence
  source 1..20: mol_type = other RNA
cacaacggagctgagaacca

SEQ ID NO: 594 - RNA, 20 nt, synthetic construct
  misc_feature 1..20: note = Antisense Sequence
  source 1..20: mol_type = other RNA
acacaacggagctgagaacc

SEQ ID NO: 595 - RNA, 20 nt, synthetic construct
  misc_feature 1..20: note = Antisense Sequence
  source 1..20: mol_type = other RNA
gacacaacggagctgagaac

SEQ ID NO: 596 - RNA, 20 nt, synthetic construct
  misc_feature 1..20: note = Antisense Sequence
  source 1..20: mol_type = other RNA
ggacacaacggagctgagaa

SEQ ID NO: 597 - RNA, 20 nt, synthetic construct
  misc_feature 1..20: note = Antisense Sequence
  source 1..20: mol_type = other RNA
tggacacaacggagctgaga

SEQ ID NO: 598 - RNA, 20 nt, synthetic construct
  misc_feature 1..20: note = Antisense Sequence
  source 1..20: mol_type = other RNA
ttggacacaacggagctgag

SEQ ID NO: 599 - RNA, 20 nt, synthetic construct
  misc_feature 1..20: note = Antisense Sequence
  source 1..20: mol_type = other RNA
accgatgttttcttcaatgg

SEQ ID NO: 600 - RNA, 20 nt, synthetic construct
  misc_feature 1..20: note = Antisense Sequence
  source 1..20: mol_type = other RNA
ccaaccgatgttttcttcaa

SEQ ID NO: 601 - RNA, 20 nt, synthetic construct
  misc_feature 1..20: note = Antisense Sequence
  source 1..20: mol_type = other RNA
tccaaccgatgttttcttca

SEQ ID NO: 602 - RNA, 20 nt, synthetic construct
  misc_feature 1..20: note = Antisense Sequence
  source 1..20: mol_type = other RNA
atccaaccgatgttttcttc

SEQ ID NO: 603 - RNA, 20 nt, synthetic construct
  misc_feature 1..20: note = Antisense Sequence
  source 1..20: mol_type = other RNA
ttcttatccatccaaccgat

SEQ ID NO: 604 - RNA, 20 nt, synthetic construct
  misc_feature 1..20: note = Antisense Sequence
  source 1..20: mol_type = other RNA
attcttatccatccaaccga

SEQ ID NO: 605 - RNA, 20 nt, synthetic construct
  misc_feature 1..20: note = Antisense Sequence
  source 1..20: mol_type = other RNA
cagccacactctgattttat

SEQ ID NO: 606 - RNA, 20 nt, synthetic construct
  misc_feature 1..20: note = Antisense Sequence
  source 1..20: mol_type = other RNA
tcactttgcagccacactct

SEQ ID NO: 607 - RNA, 20 nt, synthetic construct
  misc_feature 1..20: note = Antisense Sequence
  source 1..20: mol_type = other RNA
ttcactttgcagccacactc

SEQ ID NO: 608 - RNA, 20 nt, synthetic construct
  misc_feature 1..20: note = Antisense Sequence
  source 1..20: mol_type = other RNA
cttttcactttgcagccaca

SEQ ID NO: 609 - RNA, 20 nt, synthetic construct
  misc_feature 1..20: note = Antisense Sequence
  source 1..20: mol_type = other RNA
gcttttcactttgcagccac

SEQ ID NO: 610 - RNA, 20 nt, synthetic construct
  misc_feature 1..20: note = Antisense Sequence
  source 1..20: mol_type = other RNA
ttcaggatcatgttcaagct

SEQ ID NO: 611 - RNA, 20 nt, synthetic construct
  misc_feature 1..20: note = Antisense Sequence
  source 1..20: mol_type = other RNA
cttcaggatcatgttcaagc

SEQ ID NO: 612 - RNA, 20 nt, synthetic construct
  misc_feature 1..20: note = Antisense Sequence
  source 1..20: mol_type = other RNA
gcttcaggatcatgttcaag

SEQ ID NO: 613 - RNA, 20 nt, synthetic construct
  misc_feature 1..20: note = Antisense Sequence
  source 1..20: mol_type = other RNA
cagcttcaggatcatgttca

SEQ ID NO: 614 - RNA, 20 nt, synthetic construct
  misc_feature 1..20: note = Antisense Sequence
  source 1..20: mol_type = other RNA
tcagcttcaggatcatgttc

SEQ ID NO: 615 - RNA, 20 nt, synthetic construct
  misc_feature 1..20: note = Antisense Sequence
  source 1..20: mol_type = other RNA
gtcagcttcaggatcatgtt

SEQ ID NO: 616 - RNA, 20 nt, synthetic construct
  misc_feature 1..20: note = Antisense Sequence
  source 1..20: mol_type = other RNA
gcgtcagcttcaggatcatg

SEQ ID NO: 617 - RNA, 20 nt, synthetic construct
  misc_feature 1..20: note = Antisense Sequence
  source 1..20: mol_type = other RNA
tgcgtcagcttcaggatcat

SEQ ID NO: 618 - RNA, 20 nt, synthetic construct
  misc_feature 1..20: note = Antisense Sequence
  source 1..20: mol_type = other RNA
ttgcgtcagcttcaggatca

SEQ ID NO: 619 - RNA, 20 nt, synthetic construct
  misc_feature 1..20: note = Antisense Sequence
  source 1..20: mol_type = other RNA
gttgcgtcagcttcaggatc

SEQ ID NO: 620 - RNA, 20 nt, synthetic construct
  misc_feature 1..20: note = Antisense Sequence
  source 1..20: mol_type = other RNA
tgttgcgtcagcttcaggat

SEQ ID NO: 621 - RNA, 20 nt, synthetic construct
  misc_feature 1..20: note = Antisense Sequence
  source 1..20: mol_type = other RNA
ctgttgcgtcagcttcagga

SEQ ID NO: 622 - RNA, 20 nt, synthetic construct
  misc_feature 1..20: note = Antisense Sequence
  source 1..20: mol_type = other RNA
tcctgttgcgtcagcttcag

SEQ ID NO: 623 - RNA, 20 nt, synthetic construct
  misc_feature 1..20: note = Antisense Sequence
  source 1..20: mol_type = other RNA
atcctgttgcgtcagcttca

SEQ ID NO: 624 - RNA, 20 nt, synthetic construct
  misc_feature 1..20: note = Antisense Sequence
  source 1..20: mol_type = other RNA
tcatcctgttgcgtcagctt

SEQ ID NO: 625 - RNA, 20 nt, synthetic construct
  misc_feature 1..20: note = Antisense Sequence
  source 1..20: mol_type = other RNA
ttcatcctgttgcgtcagct

SEQ ID NO: 626 - RNA, 20 nt, synthetic construct
  misc_feature 1..20: note = Antisense Sequence
  source 1..20: mol_type = other RNA
tttcatcctgttgcgtcagc

SEQ ID NO: 627 - RNA, 20 nt, synthetic construct
  misc_feature 1..20: note = Antisense Sequence
  source 1..20: mol_type = other RNA
ttttcatcctgttgcgtcag

SEQ ID NO: 628 - RNA, 20 nt, synthetic construct
  misc_feature 1..20: note = Antisense Sequence
  source 1..20: mol_type = other RNA
attttcatcctgttgcgtca

SEQ ID NO: 629 - RNA, 20 nt, synthetic construct
  misc_feature 1..20: note = Antisense Sequence
  source 1..20: mol_type = other RNA
cattccgtttgatgtagcat

SEQ ID NO: 630 - RNA, 20 nt, synthetic construct
  misc_feature 1..20: note = Antisense Sequence
  source 1..20: mol_type = other RNA
ttgctagatggagatgaagt

SEQ ID NO: 631 - RNA, 20 nt, synthetic construct
  misc_feature 1..20: note = Antisense Sequence
  source 1..20: mol_type = other RNA
tttgctagatggagatgaag

SEQ ID NO: 632 - RNA, 20 nt, synthetic construct
  misc_feature 1..20: note = Antisense Sequence
  source 1..20: mol_type = other RNA
catttgctagatggagatga

SEQ ID NO: 633 - RNA, 20 nt, synthetic construct
  misc_feature 1..20: note = Antisense Sequence
  source 1..20: mol_type = other RNA
tcatttgctagatggagatg

SEQ ID NO: 634 - RNA, 20 nt, synthetic construct
  misc_feature 1..20: note = Antisense Sequence
  source 1..20: mol_type = other RNA
gcctcatttgctagatggag

SEQ ID NO: 635 - RNA, 20 nt, synthetic construct
  misc_feature 1..20: note = Antisense Sequence
  source 1..20: mol_type = other RNA
tgcctcatttgctagatgga

SEQ ID NO: 636 - RNA, 20 nt, synthetic construct
  misc_feature 1..20: note = Antisense Sequence
  source 1..20: mol_type = other RNA
gtgcctcatttgctagatgg

SEQ ID NO: 637 - RNA, 20 nt, synthetic construct
  misc_feature 1..20: note = Antisense Sequence
  source 1..20: mol_type = other RNA
agaacagtgcctcatttgct

SEQ ID NO: 638 - RNA, 20 nt, synthetic construct
  misc_feature 1..20: note = Antisense Sequence
  source 1..20: mol_type = other RNA
gagaacagtgcctcatttgc

SEQ ID NO: 639 - RNA, 20 nt, synthetic construct
  misc_feature 1..20: note = Antisense Sequence
  source 1..20: mol_type = other RNA
ttggttgagaacagtgcctc

SEQ ID NO: 640 - RNA, 20 nt, synthetic construct
  misc_feature 1..20: note = Antisense Sequence
  source 1..20: mol_type = other RNA
tttggttgagaacagtgcct

SEQ ID NO: 641 - RNA, 20 nt, synthetic construct
  misc_feature 1..20: note = Antisense Sequence
  source 1..20: mol_type = other RNA
ctttggttgagaacagtgcc

SEQ ID NO: 642 - RNA, 20 nt, synthetic construct
  misc_feature 1..20: note = Antisense Sequence
  source 1..20: mol_type = other RNA
gaccacagcacatcaaatta

SEQ ID NO: 643 - RNA, 20 nt, synthetic construct
  misc_feature 1..20: note = Antisense Sequence
  source 1..20: mol_type = other RNA
caaggagaccacagcacatc

SEQ ID NO: 644 - RNA, 20 nt, synthetic construct
  misc_feature 1..20: note = Antisense Sequence
  source 1..20: mol_type = other RNA
ccaaggagaccacagcacat

SEQ ID NO: 645 - RNA, 20 nt, synthetic construct
  misc_feature 1..20: note = Antisense Sequence
  source 1..20: mol_type = other RNA
accaaggagaccacagcaca

SEQ ID NO: 646 - RNA, 20 nt, synthetic construct
  misc_feature 1..20: note = Antisense Sequence
  source 1..20: mol_type = other RNA
ttaccaaggagaccacagca

SEQ ID NO: 647 - RNA, 20 nt, synthetic construct
  misc_feature 1..20: note = Antisense Sequence
  source 1..20: mol_type = other RNA
cattaccaaggagaccacag

SEQ ID NO: 648 - RNA, 20 nt, synthetic construct
  misc_feature 1..20: note = Antisense Sequence
  source 1..20: mol_type = other RNA
acattaccaaggagaccaca

SEQ ID NO: 649 - RNA, 20 nt, synthetic construct
  misc_feature 1..20: note = Antisense Sequence
  source 1..20: mol_type = other RNA
tacattaccaaggagaccac

SEQ ID NO: 650 - RNA, 20 nt, synthetic construct
  misc_feature 1..20: note = Antisense Sequence
  source 1..20: mol_type = other RNA
atacattaccaaggagacca

SEQ ID NO: 651 - RNA, 20 nt, synthetic construct
  misc_feature 1..20: note = Antisense Sequence
  source 1..20: mol_type = other RNA
cacctgtgcaataccaaatt

SEQ ID NO: 652 - RNA, 20 nt, synthetic construct
  misc_feature 1..20: note = Antisense Sequence
  source 1..20: mol_type = other RNA
tcacctgtgcaataccaaat

SEQ ID NO: 653 - RNA, 20 nt, synthetic construct
  misc_feature 1..20: note = Antisense Sequence
  source 1..20: mol_type = other RNA
atcacctgtgcaataccaaa

SEQ ID NO: 654 - RNA, 20 nt, synthetic construct
  misc_feature 1..20: note = Antisense Sequence
  source 1..20: mol_type = other RNA
aatcacctgtgcaataccaa

SEQ ID NO: 655 - RNA, 20 nt, synthetic construct
  misc_feature 1..20: note = Antisense Sequence
  source 1..20: mol_type = other RNA
actaatcacctgtgcaatac

SEQ ID NO: 656 - RNA, 20 nt, synthetic construct
  misc_feature 1..20: note = Antisense Sequence
  source 1..20: mol_type = other RNA
gactaatcacctgtgcaata

SEQ ID NO: 657 - RNA, 20 nt, synthetic construct
  misc_feature 1..20: note = Antisense Sequence
  source 1..20: mol_type = other RNA
tgactaatcacctgtgcaat

SEQ ID NO: 658 - RNA, 20 nt, synthetic construct
  misc_feature 1..20: note = Antisense Sequence
  source 1..20: mol_type = other RNA
ttgactaatcacctgtgcaa

SEQ ID NO: 659 - RNA, 20 nt, synthetic construct
  misc_feature 1..20: note = Antisense Sequence
  source 1..20: mol_type = other RNA
ccttgactaatcacctgtgc

SEQ ID NO: 660 - RNA, 20 nt, synthetic construct
  misc_feature 1..20: note = Antisense Sequence
  source 1..20: mol_type = other RNA
tccttgactaatcacctgtg

SEQ ID NO: 661 - RNA, 20 nt, synthetic construct
  misc_feature 1..20: note = Antisense Sequence
  source 1..20: mol_type = other RNA
ttccttgactaatcacctgt

SEQ ID NO: 662 - RNA, 20 nt, synthetic construct
  misc_feature 1..20: note = Antisense Sequence
  source 1..20: mol_type = other RNA
cttccttgactaatcacctg

SEQ ID NO: 663 - RNA, 20 nt, synthetic construct
  misc_feature 1..20: note = Antisense Sequence
  source 1..20: mol_type = other RNA
acttccttgactaatcacct

SEQ ID NO: 664 - RNA, 20 nt, synthetic construct
  misc_feature 1..20: note = Antisense Sequence
  source 1..20: mol_type = other RNA
gacttccttgactaatcacc

SEQ ID NO: 665 - RNA, 20 nt, synthetic construct
  misc_feature 1..20: note = Antisense Sequence
  source 1..20: mol_type = other RNA
agacttccttgactaatcac

SEQ ID NO: 666 - RNA, 20 nt, synthetic construct
  misc_feature 1..20: note = Antisense Sequence
  source 1..20: mol_type = other RNA
cagacttccttgactaatca

SEQ ID NO: 667 - RNA, 20 nt, synthetic construct
  misc_feature 1..20: note = Antisense Sequence
  source 1..20: mol_type = other RNA
aaggctgtgggaccaaagct

SEQ ID NO: 668 - RNA, 20 nt, synthetic construct
  misc_feature 1..20: note = Antisense Sequence
  source 1..20: mol_type = other RNA
gcaaggctgtgggaccaaag

SEQ ID NO: 669 - RNA, 20 nt, synthetic construct
  misc_feature 1..20: note = Antisense Sequence
  source 1..20: mol_type = other RNA
ggcaaggctgtgggaccaaa

SEQ ID NO: 670 - RNA, 20 nt, synthetic construct
  misc_feature 1..20: note = Antisense Sequence
  source 1..20: mol_type = other RNA
tgctgtgaggcaaggctgtg

SEQ ID NO: 671 - RNA, 20 nt, synthetic construct
  misc_feature 1..20: note = Antisense Sequence
  source 1..20: mol_type = other RNA
catgctgtgaggcaaggctg

SEQ ID NO: 672 - RNA, 20 nt, synthetic construct
  misc_feature 1..20: note = Antisense Sequence
  source 1..20: mol_type = other RNA
acatgctgtgaggcaaggct

SEQ ID NO: 673 - RNA, 20 nt, synthetic construct
  misc_feature 1..20: note = Antisense Sequence
  source 1..20: mol_type = other RNA
tttacatgctgtgaggcaag

SEQ ID NO: 674 - RNA, 20 nt, synthetic construct
  misc_feature 1..20: note = Antisense Sequence
  source 1..20: mol_type = other RNA
atttacatgctgtgaggcaa

SEQ ID NO: 675 - RNA, 20 nt, synthetic construct
  misc_feature 1..20: note = Antisense Sequence
  source 1..20: mol_type = other RNA
gaagaacctcagcatcaata

SEQ ID NO: 676 - RNA, 20 nt, synthetic construct
  misc_feature 1..20: note = Antisense Sequence
  source 1..20: mol_type = other RNA
agaagaacctcagcatcaat

SEQ ID NO: 677 - RNA, 20 nt, synthetic construct
  misc_feature 1..20: note = Antisense Sequence
  source 1..20: mol_type = other RNA
tagaagaacctcagcatcaa

SEQ ID NO: 678 - RNA, 20 nt, synthetic construct
  misc_feature 1..20: note = Antisense Sequence
  source 1..20: mol_type = other RNA
cagtagaagaacctcagcat

SEQ ID NO: 679 - RNA, 20 nt, synthetic construct
  misc_feature 1..20: note = Antisense Sequence
  source 1..20: mol_type = other RNA
ctagcagtagaagaacctca

SEQ ID NO: 680 - RNA, 20 nt, synthetic construct
  misc_feature 1..20: note = Antisense Sequence
  source 1..20: mol_type = other RNA
actagcagtagaagaacctc

SEQ ID NO: 681 - RNA, 20 nt, synthetic construct
  misc_feature 1..20: note = Antisense Sequence
  source 1..20: mol_type = other RNA
gtcactttcatactagcagt

SEQ ID NO: 682 - RNA, 20 nt, synthetic construct
  misc_feature 1..20: note = Antisense Sequence
  source 1..20: mol_type = other RNA
cccaattcacaccagtaaaa

SEQ ID NO: 683 - RNA, 20 nt, synthetic construct
  misc_feature 1..20: note = Antisense Sequence
  source 1..20: mol_type = other RNA
tcccaattcacaccagtaaa

SEQ ID NO: 684 - RNA, 20 nt, synthetic construct
  misc_feature 1..20: note = Antisense Sequence
  source 1..20: mol_type = other RNA
cttcccaattcacaccagta

SEQ ID NO: 685 - RNA, 20 nt, synthetic construct
  misc_feature 1..20: note = Antisense Sequence
  source 1..20: mol_type = other RNA
cgtcatggaatagcattgtt

SEQ ID NO: 686 - RNA, 20 nt, synthetic construct
  misc_feature 1..20: note = Antisense Sequence
  source 1..20: mol_type = other RNA
acgtcatggaatagcattgt

SEQ ID NO: 687 - RNA, 20 nt, synthetic construct
  misc_feature 1..20: note = Antisense Sequence
  source 1..20: mol_type = other RNA
caaacgtcatggaatagcat

SEQ ID NO: 688 - RNA, 20 nt, synthetic construct
  misc_feature 1..20: note = Antisense Sequence
  source 1..20: mol_type = other RNA
acaaacgtcatggaatagca

SEQ ID NO: 689 - RNA, 20 nt, synthetic construct
  misc_feature 1..20: note = Antisense Sequence
  source 1..20: mol_type = other RNA
tacaaacgtcatggaatagc

SEQ ID NO: 690 - RNA, 20 nt, synthetic construct
  misc_feature 1..20: note = Antisense Sequence
  source 1..20: mol_type = other RNA
cacatagtcaaggaccttaa

SEQ ID NO: 691 - RNA, 20 nt, synthetic construct
  misc_feature 1..20: note = Antisense Sequence
  source 1..20: mol_type = other RNA
acacatagtcaaggacctta

SEQ ID NO: 692 - RNA, 20 nt, synthetic construct
  misc_feature 1..20: note = Antisense Sequence
  source 1..20: mol_type = other RNA
tacacatagtcaaggacctt

SEQ ID NO: 693 - RNA, 20 nt, synthetic construct
  misc_feature 1..20: note = Antisense Sequence
  source 1..20: mol_type = other RNA
gtacacatagtcaaggacct

SEQ ID NO: 694 - RNA, 20 nt, synthetic construct
  misc_feature 1..20: note = Antisense Sequence
  source 1..20: mol_type = other RNA
cgagatggcagagattaact

SEQ ID NO: 695 - RNA, 20 nt, synthetic construct
  misc_feature 1..20: note = Antisense Sequence
  source 1..20: mol_type = other RNA
gcgagatggcagagattaac

SEQ ID NO: 696 - RNA, 20 nt, synthetic construct
  misc_feature 1..20: note = Antisense Sequence
  source 1..20: mol_type = other RNA
atttagcgagatggcagaga

SEQ ID NO: 697 - RNA, 20 nt, synthetic construct
  misc_feature 1..20: note = Antisense Sequence
  source 1..20: mol_type = other RNA
gatttagcgagatggcagag

SEQ ID NO: 698 - RNA, 20 nt, synthetic construct
  misc_feature 1..20: note = Antisense Sequence
  source 1..20: mol_type = other RNA
tgatttagcgagatggcaga

SEQ ID NO: 699 - RNA, 20 nt, synthetic construct
  misc_feature 1..20: note = Antisense Sequence
  source 1..20: mol_type = other RNA
atgatttagcgagatggcag

SEQ ID NO: 700 - RNA, 20 nt, synthetic construct
  misc_feature 1..20: note = Antisense Sequence
  source 1..20: mol_type = other RNA
gatgatttagcgagatggca

SEQ ID NO: 701 - RNA, 20 nt, synthetic construct
  misc_feature 1..20: note = Antisense Sequence
  source 1..20: mol_type = other RNA
tgatgatttagcgagatggc

SEQ ID NO: 702 - RNA, 20 nt, synthetic construct
  misc_feature 1..20: note = Antisense Sequence
  source 1..20: mol_type = other RNA
ctgatgatttagcgagatgg

SEQ ID NO: 703 - RNA, 20 nt, synthetic construct
  misc_feature 1..20: note = Antisense Sequence
  source 1..20: mol_type = other RNA
actgatgatttagcgagatg

SEQ ID NO: 704 - RNA, 20 nt, synthetic construct
  misc_feature 1..20: note = Antisense Sequence
  source 1..20: mol_type = other RNA
gactgatgatttagcgagat

SEQ ID NO: 705 - RNA, 20 nt, synthetic construct
  misc_feature 1..20: note = Antisense Sequence
  source 1..20: mol_type = other RNA
agactgatgatttagcgaga

SEQ ID NO: 706 - RNA, 20 nt, synthetic construct
  misc_feature 1..20: note = Antisense Sequence
  source 1..20: mol_type = other RNA
gatcaggcaccttctatttc

SEQ ID NO: 707 - RNA, 20 nt, synthetic construct
  misc_feature 1..20: note = Antisense Sequence
  source 1..20: mol_type = other RNA
agatcaggcaccttctattt

SEQ ID NO: 708 - RNA, 20 nt, synthetic construct
  misc_feature 1..20: note = Antisense Sequence
  source 1..20: mol_type = other RNA
ttaggaagatcaggcacctt

SEQ ID NO: 709 - RNA, 20 nt, synthetic construct
  misc_feature 1..20: note = Antisense Sequence
  source 1..20: mol_type = other RNA
attaggaagatcaggcacct

SEQ ID NO: 710 - RNA, 20 nt, synthetic construct
  misc_feature 1..20: note = Antisense Sequence
  source 1..20: mol_type = other RNA
tattaggaagatcaggcacc

SEQ ID NO: 711 - RNA, 20 nt, synthetic construct
  misc_feature 1..20: note = Antisense Sequence
  source 1..20: mol_type = other RNA
gcagcacatcttatttggga

SEQ ID NO: 712 - RNA, 20 nt, synthetic construct
  misc_feature 1..20: note = Antisense Sequence
  source 1..20: mol_type = other RNA
agcagcacatcttatttggg

SEQ ID NO: 713 - RNA, 20 nt, synthetic construct
  misc_feature 1..20: note = Antisense Sequence
  source 1..20: mol_type = other RNA
aagcagcacatcttatttgg

SEQ ID NO: 714 - RNA, 20 nt, synthetic construct
  misc_feature 1..20: note = Antisense Sequence
  source 1..20: mol_type = other RNA
ctcggtaagcagcacatctt

SEQ ID NO: 715 - RNA, 20 nt, synthetic construct
  misc_feature 1..20: note = Antisense Sequence
  source 1..20: mol_type = other RNA
cctcggtaagcagcacatct

SEQ ID NO: 716 - RNA, 20 nt, synthetic construct
  misc_feature 1..20: note = Antisense Sequence
  source 1..20: mol_type = other RNA
acctcggtaagcagcacatc

SEQ ID NO: 717 - RNA, 20 nt, synthetic construct
  misc_feature 1..20: note = Antisense Sequence
  source 1..20: mol_type = other RNA
tacctcggtaagcagcacat

SEQ ID NO: 718 - RNA, 20 nt, synthetic construct
  misc_feature 1..20: note = Antisense Sequence
  source 1..20: mol_type = other RNA
atacctcggtaagcagcaca

SEQ ID NO: 719 - RNA, 20 nt, synthetic construct
  misc_feature 1..20: note = Antisense Sequence
  source 1..20: mol_type = other RNA
gatacctcggtaagcagcac

SEQ ID NO: 720 - RNA, 20 nt, synthetic construct
  misc_feature 1..20: note = Antisense Sequence
  source 1..20: mol_type = other RNA
tgatacctcggtaagcagca

SEQ ID NO: 721 - RNA, 20 nt, synthetic construct
  misc_feature 1..20: note = Antisense Sequence
  source 1..20: mol_type = other RNA
gtgatacctcggtaagcagc

SEQ ID NO: 722 - RNA, 20 nt, synthetic construct
  misc_feature 1..20: note = Antisense Sequence
  source 1..20: mol_type = other RNA
cgtgatacctcggtaagcag

SEQ ID NO: 723 - RNA, 20 nt, synthetic construct
  misc_feature 1..20: note = Antisense Sequence
  source 1..20: mol_type = other RNA
ccgtgatacctcggtaagca

SEQ ID NO: 724 - RNA, 20 nt, synthetic construct
  misc_feature 1..20: note = Antisense Sequence
  source 1..20: mol_type = other RNA
cccgtgatacctcggtaagc

SEQ ID NO: 725 - RNA, 20 nt, synthetic construct
  misc_feature 1..20: note = Antisense Sequence
  source 1..20: mol_type = other RNA
tcaacgacccaagctggagc

SEQ ID NO: 726 - RNA, 20 nt, synthetic construct
  misc_feature 1..20: note = Antisense Sequence
  source 1..20: mol_type = other RNA
ttcaacgacccaagctggag

SEQ ID NO: 727 - RNA, 20 nt, synthetic construct
  misc_feature 1..20: note = Antisense Sequence
  source 1..20: mol_type = other RNA
cttcaacgacccaagctgga

SEQ ID NO: 728 - RNA, 20 nt, synthetic construct
  misc_feature 1..20: note = Antisense Sequence
  source 1..20: mol_type = other RNA
cccagcttcaacgacccaag

SEQ ID NO: 729 - RNA, 20 nt, synthetic construct
  misc_feature 1..20: note = Antisense Sequence
  source 1..20: mol_type = other RNA
tctctgaagtggtttcccaa

SEQ ID NO: 730 - RNA, 20 nt, synthetic construct
  misc_feature 1..20: note = Antisense Sequence
  source 1..20: mol_type = other RNA
atctctgaagtggtttccca

SEQ ID NO: 731 - RNA, 20 nt, synthetic construct
  misc_feature 1..20: note = Antisense Sequence
  source 1..20: mol_type = other RNA
catctctgaagtggtttccc

SEQ ID NO: 732 - RNA, 20 nt, synthetic construct
  misc_feature 1..20: note = Antisense Sequence
  source 1..20: mol_type = other RNA
gatggcattgtgctcataat

SEQ ID NO: 733 - RNA, 20 nt, synthetic construct
  misc_feature 1..20: note = Antisense Sequence
  source 1..20: mol_type = other RNA
tgatggcattgtgctcataa

SEQ ID NO: 734 - RNA, 20 nt, synthetic construct
  misc_feature 1..20: note = Antisense Sequence
  source 1..20: mol_type = other RNA
gtgatggcattgtgctcata

SEQ ID NO: 735 - RNA, 20 nt, synthetic construct
  misc_feature 1..20: note = Antisense Sequence
  source 1..20: mol_type = other RNA
gttaagtgatggcattgtgc

SEQ ID NO: 736 - RNA, 20 nt, synthetic construct
  misc_feature 1..20: note = Antisense Sequence
  source 1..20: mol_type = other RNA
agttaagtgatggcattgtg

SEQ ID NO: 737 - RNA, 20 nt, synthetic construct
  misc_feature 1..20: note = Antisense Sequence
  source 1..20: mol_type = other RNA
gagtctatttggtcaagaga

SEQ ID NO: 738 - RNA, 20 nt, synthetic construct
  misc_feature 1..20: note = Antisense Sequence
  source 1..20: mol_type = other RNA
tgagtctatttggtcaagag

SEQ ID NO: 739 - RNA, 20 nt, synthetic construct
  misc_feature 1..20: note = Antisense Sequence
  source 1..20: mol_type = other RNA
ccataactcactcactagaa

SEQ ID NO: 740 - RNA, 20 nt, synthetic construct
  misc_feature 1..20: note = Antisense Sequence
  source 1..20: mol_type = other RNA
agcaccataactcactcact

SEQ ID NO: 741 - RNA, 20 nt, synthetic construct
  misc_feature 1..20: note = Antisense Sequence
  source 1..20: mol_type = other RNA
ccagcaccataactcactca

SEQ ID NO: 742 - RNA, 20 nt, synthetic construct
  misc_feature 1..20: note = Antisense Sequence
  source 1..20: mol_type = other RNA
gccagcaccataactcactc

SEQ ID NO: 743 - RNA, 20 nt, synthetic construct
  misc_feature 1..20: note = Antisense Sequence
  source 1..20: mol_type = other RNA
agccagcaccataactcact

SEQ ID NO: 744 - RNA, 20 nt, synthetic construct
  misc_feature 1..20: note = Antisense Sequence
  source 1..20: mol_type = other RNA
tagccagcaccataactcac

SEQ ID NO: 745 - RNA, 20 nt, synthetic construct
  misc_feature 1..20: note = Antisense Sequence
  source 1..20: mol_type = other RNA
atagccagcaccataactca

SEQ ID NO: 746 - RNA, 20 nt, synthetic construct
  misc_feature 1..20: note = Antisense Sequence
  source 1..20: mol_type = other RNA
tatagccagcaccataactc

SEQ ID NO: 747 - RNA, 20 nt, synthetic construct
  misc_feature 1..20: note = Antisense Sequence
  source 1..20: mol_type = other RNA
aatatagccagcaccataac

SEQ ID NO: 748 - RNA, 20 nt, synthetic construct
  misc_feature 1..20: note = Antisense Sequence
  source 1..20: mol_type = other RNA
caaaatatagccagcaccat

SEQ ID NO: 749 - RNA, 20 nt, synthetic construct
  misc_feature 1..20: note = Antisense Sequence
  source 1..20: mol_type = other RNA
gcaaaatatagccagcacca

SEQ ID NO: 750 - RNA, 20 nt, synthetic construct
  misc_feature 1..20: note = Antisense Sequence
  source 1..20: mol_type = other RNA
gcaacatttgagagggcagt

SEQ ID NO: 751 - RNA, 20 nt, synthetic construct
  misc_feature 1..20: note = Antisense Sequence
  source 1..20: mol_type = other RNA
agcaacatttgagagggcag

SEQ ID NO: 752 - RNA, 20 nt, synthetic construct
  misc_feature 1..20: note = Antisense Sequence
  source 1..20: mol_type = other RNA
tagcaacatttgagagggca

SEQ ID NO: 753 - RNA, 20 nt, synthetic construct
  misc_feature 1..20: note = Antisense Sequence
  source 1..20: mol_type = other RNA
ctagcaacatttgagagggc

SEQ ID NO: 754 - RNA, 20 nt, synthetic construct
  misc_feature 1..20: note = Antisense Sequence
  source 1..20: mol_type = other RNA
cctagcaacatttgagaggg

SEQ ID NO: 755 - RNA, 20 nt, synthetic construct
  misc_feature 1..20: note = Antisense Sequence
  source 1..20: mol_type = other RNA
tcctagcaacatttgagagg

SEQ ID NO: 756 - RNA, 20 nt, synthetic construct
  misc_feature 1..20: note = Antisense Sequence
  source 1..20: mol_type = other RNA
ttcctagcaacatttgagag

SEQ ID NO: 757 - RNA, 20 nt, synthetic construct
  misc_feature 1..20: note = Antisense Sequence
  source 1..20: mol_type = other RNA
aaattctggcaagcaaggcc

SEQ ID NO: 758 - RNA, 20 nt, synthetic construct
  misc_feature 1..20: note = Antisense Sequence
  source 1..20: mol_type = other RNA
tcaaattctggcaagcaagg

SEQ ID NO: 759 - RNA, 20 nt, synthetic construct
  misc_feature 1..20: note = Antisense Sequence
  source 1..20: mol_type = other RNA
agtcaaattctggcaagcaa

SEQ ID NO: 760 - RNA, 20 nt, synthetic construct
  misc_feature 1..20: note = Antisense Sequence
  source 1..20: mol_type = other RNA
aagtcaaattctggcaagca

SEQ ID NO: 761 - RNA, 20 nt, synthetic construct
  misc_feature 1..20: note = Antisense Sequence
  source 1..20: mol_type = other RNA
aaagtcaaattctggcaagc

SEQ ID NO: 762 - RNA, 20 nt, synthetic construct
  misc_feature 1..20: note = Antisense Sequence
  source 1..20: mol_type = other RNA
ctgaaacctgacaccgtata

SEQ ID NO: 763 - RNA, 20 nt, synthetic construct
  misc_feature 1..20: note = Antisense Sequence
  source 1..20: mol_type = other RNA
cctgaaacctgacaccgtat

SEQ ID NO: 764 - RNA, 20 nt, synthetic construct
  misc_feature 1..20: note = Antisense Sequence
  source 1..20: mol_type = other RNA
ccctgaaacctgacaccgta

SEQ ID NO: 765 - RNA, 20 nt, synthetic construct
  misc_feature 1..20: note = Antisense Sequence
  source 1..20: mol_type = other RNA
accctgaaacctgacaccgt

SEQ ID NO: 766 - RNA, 20 nt, synthetic construct
  misc_feature 1..20: note = Antisense Sequence
  source 1..20: mol_type = other RNA
caccaaagagttctggactt

SEQ ID NO: 767 - RNA, 20 nt, synthetic construct
  misc_feature 1..20: note = Antisense Sequence
  source 1..20: mol_type = other RNA
tcaccaaagagttctggact

SEQ ID NO: 768 - RNA, 20 nt, synthetic construct
  misc_feature 1..20: note = Antisense Sequence
  source 1..20: mol_type = other RNA
gtcaccaaagagttctggac

SEQ ID NO: 769 - RNA, 20 nt, synthetic construct
  misc_feature 1..20: note = Antisense Sequence
  source 1..20: mol_type = other RNA
agtcaccaaagagttctgga

SEQ ID NO: 770 - RNA, 20 nt, synthetic construct
  misc_feature 1..20: note = Antisense Sequence
  source 1..20: mol_type = other RNA
aaaacggctttacagggtat

SEQ ID NO: 771 - RNA, 20 nt, synthetic construct
  misc_feature 1..20: note = Antisense Sequence
  source 1..20: mol_type = other RNA
gaccataggttgtttcatac

SEQ ID NO: 772 - RNA, 20 nt, synthetic construct
  misc_feature 1..20: note = Antisense Sequence
  source 1..20: mol_type = other RNA
cagaccataggttgtttcat

SEQ ID NO: 773 - RNA, 20 nt, synthetic construct
  misc_feature 1..20: note = Antisense Sequence
  source 1..20: mol_type = other RNA
ccagaccataggttgtttca

SEQ ID NO: 774 - RNA, 20 nt, synthetic construct
  misc_feature 1..20: note = Antisense Sequence
  source 1..20: mol_type = other RNA
tccagaccataggttgtttc

SEQ ID NO: 775 - RNA, 20 nt, synthetic construct
  misc_feature 1..20: note = Antisense Sequence
  source 1..20: mol_type = other RNA
ttccagaccataggttgttt

SEQ ID NO: 776 - RNA, 20 nt, synthetic construct
  misc_feature 1..20: note = Antisense Sequence
  source 1..20: mol_type = other RNA
tttccagaccataggttgtt

SEQ ID NO: 777 - RNA, 20 nt, synthetic construct
  misc_feature 1..20: note = Antisense Sequence
  source 1..20: mol_type = other RNA
atttccagaccataggttgt

SEQ ID NO: 778 - RNA, 20 nt, synthetic construct
  misc_feature 1..20: note = Antisense Sequence
  source 1..20: mol_type = other RNA
aatttccagaccataggttg

SEQ ID NO: 779 - RNA, 20 nt, synthetic construct
  misc_feature 1..20: note = Antisense Sequence
  source 1..20: mol_type = other RNA
cacatatagctttgcgatac

SEQ ID NO: 780 - RNA, 20 nt, synthetic construct
  misc_feature 1..20: note = Antisense Sequence
  source 1..20: mol_type = other RNA
gcacatatagctttgcgata

SEQ ID NO: 781 - RNA, 20 nt, synthetic construct
  misc_feature 1..20: note = Antisense Sequence
  source 1..20: mol_type = other RNA
tgcacatatagctttgcgat

SEQ ID NO: 782 - RNA, 20 nt, synthetic construct
  misc_feature 1..20: note = Antisense Sequence
  source 1..20: mol_type = other RNA
atgcacatatagctttgcga

SEQ ID NO: 783 - RNA, 20 nt, synthetic construct
  misc_feature 1..20: note = Antisense Sequence
  source 1..20: mol_type = other RNA
tatgcacatatagctttgcg

SEQ ID NO: 784 - RNA, 20 nt, synthetic construct
  misc_feature 1..20: note = Antisense Sequence
  source 1..20: mol_type = other RNA
gcaaactcaaagcatagatc

SEQ ID NO: 785 - RNA, 19 nt, synthetic construct
  misc_feature 1..19: note = siRNA Sense Sequence
  source 1..19: mol_type = other RNA
aaaggcgtgcacttcctac

SEQ ID NO: 786 - RNA, 19 nt, synthetic construct
  misc_feature 1..19: note = siRNA Antisense Sequence
  source 1..19: mol_type = other RNA
gtaggaagtgcacgccttt

SEQ ID NO: 787 - RNA, 19 nt, synthetic construct
  misc_feature 1..19: note = siRNA Sense Sequence
  source 1..19: mol_type = other RNA
aaggcgtgcacttcctacg

SEQ ID NO: 788 - RNA, 19 nt, synthetic construct
  misc_feature 1..19: note = siRNA Antisense Sequence
  source 1..19: mol_type = other RNA
cgtaggaagtgcacgcctt

SEQ ID NO: 789 - RNA, 19 nt, synthetic construct
  misc_feature 1..19: note = siRNA Sense Sequence
  source 1..19: mol_type = other RNA
cgtgcacttcctacgcctg

SEQ ID NO: 790 - RNA, 19 nt, synthetic construct
  misc_feature 1..19: note = siRNA Antisense Sequence
  source 1..19: mol_type = other RNA
caggcgtaggaagtgcacg

SEQ ID NO: 791 - RNA, 19 nt, synthetic construct
  misc_feature 1..19: note = siRNA Sense Sequence
  source 1..19: mol_type = other RNA
gtgcacttcctacgcctga

SEQ ID NO: 792 - RNA, 19 nt, synthetic construct
  misc_feature 1..19: note = siRNA Antisense Sequence
  source 1..19: mol_type = other RNA
tcaggcgtaggaagtgcac

SEQ ID NO: 793 - RNA, 19 nt, synthetic construct
  misc_feature 1..19: note = siRNA Sense Sequence
  source 1..19: mol_type = other RNA
tgcacttcctacgcctgat

SEQ ID NO: 794 - RNA, 19 nt, synthetic construct
  misc_feature 1..19: note = siRNA Antisense Sequence
  source 1..19: mol_type = other RNA
atcaggcgtaggaagtgca

SEQ ID NO: 795 - RNA, 19 nt, synthetic construct
  misc_feature 1..19: note = siRNA Sense Sequence
  source 1..19: mol_type = other RNA
tcgcaacctcgcagcttcc

SEQ ID NO: 796 - RNA, 19 nt, synthetic construct
  misc_feature 1..19: note = siRNA Antisense Sequence
  source 1..19: mol_type = other RNA
ggaagctgcgaggttgcga

SEQ ID NO: 797 - RNA, 19 nt, synthetic construct
  misc_feature 1..19: note = siRNA Sense Sequence
  source 1..19: mol_type = other RNA
cggcgtgcagcgctcattt

SEQ ID NO: 798 - RNA, 19 nt, synthetic construct
  misc_feature 1..19: note = siRNA Antisense Sequence
  source 1..19: mol_type = other RNA
aaatgagcgctgcacgccg

SEQ ID NO: 799 - RNA, 19 nt, synthetic construct
  misc_feature 1..19: note = siRNA Sense Sequence
  source 1..19: mol_type = other RNA
ggcgtgcagcgctcattta

SEQ ID NO: 800 - RNA, 19 nt, synthetic construct
  misc_feature 1..19: note = siRNA Antisense Sequence
  source 1..19: mol_type = other RNA
taaatgagcgctgcacgcc

SEQ ID NO: 801 - RNA, 19 nt, synthetic construct
  misc_feature 1..19: note = siRNA Sense Sequence
  source 1..19: mol_type = other RNA
gcgtgcagcgctcatttac

SEQ ID NO: 802 - RNA, 19 nt, synthetic construct
  misc_feature 1..19: note = siRNA Antisense Sequence
  source 1..19: mol_type = other RNA
gtaaatgagcgctgcacgc

SEQ ID NO: 803 - RNA, 19 nt, synthetic construct
  misc_feature 1..19: note = siRNA Sense Sequence
  source 1..19: mol_type = other RNA
cgtgcagcgctcatttacc

SEQ ID NO: 804 - RNA, 19 nt, synthetic construct
  misc_feature 1..19: note = siRNA Antisense Sequence
  source 1..19: mol_type = other RNA
ggtaaatgagcgctgcacg

SEQ ID NO: 805 - RNA, 19 nt, synthetic construct
  misc_feature 1..19: note = siRNA Sense Sequence
  source 1..19: mol_type = other RNA
gtgcagcgctcatttacca

SEQ ID NO: 806 - RNA, 19 nt, synthetic construct
  misc_feature 1..19: note = siRNA Antisense Sequence
  source 1..19: mol_type = other RNA
tggtaaatgagcgctgcac

SEQ ID NO: 807 - RNA, 19 nt, synthetic construct
  misc_feature 1..19: note = siRNA Sense Sequence
  source 1..19: mol_type = other RNA
tgcagcgctcatttaccaa

SEQ ID NO: 808 - RNA, 19 nt, synthetic construct
  misc_feature 1..19: note = siRNA Antisense Sequence
  source 1..19: mol_type = other RNA
ttggtaaatgagcgctgca

SEQ ID NO: 809 - RNA, 19 nt, synthetic construct
  misc_feature 1..19: note = siRNA Sense Sequence
  source 1..19: mol_type = other RNA
gcagcgctcatttaccaat

SEQ ID NO: 810 - RNA, 19 nt, synthetic construct
  misc_feature 1..19: note = siRNA Antisense Sequence
  source 1..19: mol_type = other RNA
attggtaaatgagcgctgc

SEQ ID NO: 811 - RNA, 19 nt, synthetic construct
  misc_feature 1..19: note = siRNA Sense Sequence
  source 1..19: mol_type = other RNA
cagcgctcatttaccaatt

SEQ ID NO: 812 - RNA, 19 nt, synthetic construct
  misc_feature 1..19: note = siRNA Antisense Sequence
  source 1..19: mol_type = other RNA
aattggtaaatgagcgctg

SEQ ID NO: 813 - RNA, 19 nt, synthetic construct
  misc_feature 1..19: note = siRNA Sense Sequence
  source 1..19: mol_type = other RNA
gctcatttaccaattccct

SEQ ID NO: 814 - RNA, 19 nt, synthetic construct
  misc_feature 1..19: note = siRNA Antisense Sequence
  source 1..19: mol_type = other RNA
agggaattggtaaatgagc

SEQ ID NO: 815 - RNA, 19 nt, synthetic construct
  misc_feature 1..19: note = siRNA Sense Sequence
  source 1..19: mol_type = other RNA
ctcatttaccaattccctt

SEQ ID NO: 816 - RNA, 19 nt, synthetic construct
  misc_feature 1..19: note = siRNA Antisense Sequence
  source 1..19: mol_type = other RNA
aagggaattggtaaatgag

SEQ ID NO: 817 - RNA, 19 nt, synthetic construct
  misc_feature 1..19: note = siRNA Sense Sequence
  source 1..19: mol_type = other RNA
tcatttaccaattcccttc

SEQ ID NO: 818 - RNA, 19 nt, synthetic construct
  misc_feature 1..19: note = siRNA Antisense Sequence
  source 1..19: mol_type = other RNA
gaagggaattggtaaatga

SEQ ID NO: 819 - RNA, 19 nt, synthetic construct
  misc_feature 1..19: note = siRNA Sense Sequence
  source 1..19: mol_type = other RNA
catttaccaattcccttcc

SEQ ID NO: 820 - RNA, 19 nt, synthetic construct
  misc_feature 1..19: note = siRNA Antisense Sequence
  source 1..19: mol_type = other RNA
ggaagggaattggtaaatg

SEQ ID NO: 821 - RNA, 19 nt, synthetic construct
  misc_feature 1..19: note = siRNA Sense Sequence
  source 1..19: mol_type = other RNA
atttaccaattcccttcct

SEQ ID NO: 822 - RNA, 19 nt, synthetic construct
  misc_feature 1..19: note = siRNA Antisense Sequence
  source 1..19: mol_type = other RNA
aggaagggaattggtaaat

SEQ ID NO: 823 - RNA, 19 nt, synthetic construct
  misc_feature 1..19: note = siRNA Sense Sequence
  source 1..19: mol_type = other RNA
cttcctgggagttgcggct

SEQ ID NO: 824 - RNA, 19 nt, synthetic construct
  misc_feature 1..19: note = siRNA Antisense Sequence
  source 1..19: mol_type = other RNA
agccgcaactcccaggaag

SEQ ID NO: 825 - RNA, 19 nt, synthetic construct
  misc_feature 1..19: note = siRNA Sense Sequence
  source 1..19: mol_type = other RNA
ttcctgggagttgcggctt

SEQ ID NO: 826 - RNA, 19 nt, synthetic construct
  misc_feature 1..19: note = siRNA Antisense Sequence
  source 1..19: mol_type = other RNA
aagccgcaactcccaggaa

SEQ ID NO: 827 - RNA, 19 nt, synthetic construct
  misc_feature 1..19: note = siRNA Sense Sequence
  source 1..19: mol_type = other RNA
tcctgggagttgcggcttc

SEQ ID NO: 828 - RNA, 19 nt, synthetic construct
  misc_feature 1..19: note = siRNA Antisense Sequence
  source 1..19: mol_type = other RNA
gaagccgcaactcccagga

SEQ ID NO: 829 - RNA, 19 nt, synthetic construct
  misc_feature 1..19: note = siRNA Sense Sequence
  source 1..19: mol_type = other RNA
cccactcccgtttaccctt

SEQ ID NO: 830 - RNA, 19 nt, synthetic construct
  misc_feature 1..19: note = siRNA Antisense Sequence
  source 1..19: mol_type = other RNA
aagggtaaacgggagtggg

SEQ ID NO: 831 - RNA, 19 nt, synthetic construct
  misc_feature 1..19: note = siRNA Sense Sequence
  source 1..19: mol_type = other RNA
ccactcccgtttacccttt

SEQ ID NO: 832 - RNA, 19 nt, synthetic construct
  misc_feature 1..19: note = siRNA Antisense Sequence
  source 1..19: mol_type = other RNA
aaagggtaaacgggagtgg

SEQ ID NO: 833 - RNA, 19 nt, synthetic construct
  misc_feature 1..19: note = siRNA Sense Sequence
  source 1..19: mol_type = other RNA
gctccactttcactttcgg

SEQ ID NO: 834 - RNA, 19 nt, synthetic construct
  misc_feature 1..19: note = siRNA Antisense Sequence
  source 1..19: mol_type = other RNA
ccgaaagtgaaagtggagc

SEQ ID NO: 835 - RNA, 19 nt, synthetic construct
  misc_feature 1..19: note = siRNA Sense Sequence
  source 1..19: mol_type = other RNA
ctccactttcactttcggt

SEQ ID NO: 836 - RNA, 19 nt, synthetic construct
  misc_feature 1..19: note = siRNA Antisense Sequence
  source 1..19: mol_type = other RNA
accgaaagtgaaagtggag

SEQ ID NO: 837 - RNA, 19 nt, synthetic construct
  misc_feature 1..19: note = siRNA Sense Sequence
  source 1..19: mol_type = other RNA
actttcactttcggtcctg

SEQ ID NO: 838 - RNA, 19 nt, synthetic construct
  misc_feature 1..19: note = siRNA Antisense Sequence
  source 1..19: mol_type = other RNA
caggaccgaaagtgaaagt

SEQ ID NO: 839 - RNA, 19 nt, synthetic construct
  misc_feature 1..19: note = siRNA Sense Sequence
  source 1..19: mol_type = other RNA
cccaggtaggtagagcaag

SEQ ID NO: 840 - RNA, 19 nt, synthetic construct
  misc_feature 1..19: note = siRNA Antisense Sequence
  source 1..19: mol_type = other RNA
cttgctctacctacctggg

SEQ ID NO: 841 - RNA, 19 nt, synthetic construct
  misc_feature 1..19: note = siRNA Sense Sequence
  source 1..19: mol_type = other RNA
ccaggtaggtagagcaaga

SEQ ID NO: 842 - RNA, 19 nt, synthetic construct
  misc_feature 1..19: note = siRNA Antisense Sequence
  source 1..19: mol_type = other RNA
tcttgctctacctacctgg

SEQ ID NO: 843 - RNA, 19 nt, synthetic construct
  misc_feature 1..19: note = siRNA Sense Sequence
  source 1..19: mol_type = other RNA
caggtaggtagagcaagaa

SEQ ID NO: 844 - RNA, 19 nt, synthetic construct
  misc_feature 1..19: note = siRNA Antisense Sequence
  source 1..19: mol_type = other RNA
ttcttgctctacctacctg

SEQ ID NO: 845 - RNA, 19 nt, synthetic construct
  misc_feature 1..19: note = siRNA Sense Sequence
  source 1..19: mol_type = other RNA
aggtaggtagagcaagaag

SEQ ID NO: 846 - RNA, 19 nt, synthetic construct
  misc_feature 1..19: note = siRNA Antisense Sequence
  source 1..19: mol_type = other RNA
cttcttgctctacctacct

SEQ ID NO: 847 - RNA, 19 nt, synthetic construct
  misc_feature 1..19: note = siRNA Sense Sequence
  source 1..19: mol_type = other RNA
ggtagagcaagaagatggt

SEQ ID NO: 848 - RNA, 19 nt, synthetic construct
  misc_feature 1..19: note = siRNA Antisense Sequence
  source 1..19: mol_type = other RNA
accatcttcttgctctacc

SEQ ID NO: 849 - RNA, 19 nt, synthetic construct
  misc_feature 1..19: note = siRNA Sense Sequence
  source 1..19: mol_type = other RNA
gtagagcaagaagatggtg

SEQ ID NO: 850 - RNA, 19 nt, synthetic construct
  misc_feature 1..19: note = siRNA Antisense Sequence
  source 1..19: mol_type = other RNA
caccatcttcttgctctac

SEQ ID NO: 851 - RNA, 19 nt, synthetic construct
  misc_feature 1..19: note = siRNA Sense Sequence
  source 1..19: mol_type = other RNA
tagagcaagaagatggtgt

SEQ ID NO: 852 - RNA, 19 nt, synthetic construct
  misc_feature 1..19: note = siRNA Antisense Sequence
  source 1..19: mol_type = other RNA
acaccatcttcttgctcta

SEQ ID NO: 853 - RNA, 19 nt, synthetic construct
  misc_feature 1..19: note = siRNA Sense Sequence
  source 1..19: mol_type = other RNA
agagcaagaagatggtgtt

SEQ ID NO: 854 - RNA, 19 nt, synthetic construct
  misc_feature 1..19: note = siRNA Antisense Sequence
  source 1..19: mol_type = other RNA
aacaccatcttcttgctct

SEQ ID NO: 855 - RNA, 19 nt, synthetic construct
  misc_feature 1..19: note = siRNA Sense Sequence
  source 1..19: mol_type = other RNA
gagcaagaagatggtgttt

SEQ ID NO: 856 - RNA, 19 nt, synthetic construct
  misc_feature 1..19: note = siRNA Antisense Sequence
  source 1..19: mol_type = other RNA
aaacaccatcttcttgctc

SEQ ID NO: 857 - RNA, 19 nt, synthetic construct
  misc_feature 1..19: note = siRNA Sense Sequence
  source 1..19: mol_type = other RNA
gaagatggtgtttctgccc

SEQ ID NO: 858 - RNA, 19 nt, synthetic construct
  misc_feature 1..19: note = siRNA Antisense Sequence
  source 1..19: mol_type = other RNA
gggcagaaacaccatcttc

SEQ ID NO: 859 - RNA, 19 nt, synthetic construct
  misc_feature 1..19: note = siRNA Sense Sequence
  source 1..19: mol_type = other RNA
tcactgttggctctcttaa

SEQ ID NO: 860 - RNA, 19 nt, synthetic construct
  misc_feature 1..19: note = siRNA Antisense Sequence
  source 1..19: mol_type = other RNA
ttaagagagccaacagtga

SEQ ID NO: 861 - RNA, 19 nt, synthetic construct
  misc_feature 1..19: note = siRNA Sense Sequence
  source 1..19: mol_type = other RNA
cactgttggctctcttaac

SEQ ID NO: 862 - RNA, 19 nt, synthetic construct
  misc_feature 1..19: note = siRNA Antisense Sequence
  source 1..19: mol_type = other RNA
gttaagagagccaacagtg

SEQ ID NO: 863 - RNA, 19 nt, synthetic construct
  misc_feature 1..19: note = siRNA Sense Sequence
  source 1..19: mol_type = other RNA
actgttggctctcttaact

SEQ ID NO: 864 - RNA, 19 nt, synthetic construct
  misc_feature 1..19: note = siRNA Antisense Sequence
  source 1..19: mol_type = other RNA
agttaagagagccaacagt

SEQ ID NO: 865 - RNA, 19 nt, synthetic construct
  misc_feature 1..19: note = siRNA Sense Sequence
  source 1..19: mol_type = other RNA
ggctctcttaactgtgtcc

SEQ ID NO: 866 - RNA, 19 nt, synthetic construct
  misc_feature 1..19: note = siRNA Antisense Sequence
  source 1..19: mol_type = other RNA
ggacacagttaagagagcc

SEQ ID NO: 867 - RNA, 19 nt, synthetic construct
  misc_feature 1..19: note = siRNA Sense Sequence
  source 1..19: mol_type = other RNA
gctctcttaactgtgtcca

SEQ ID NO: 868 - RNA, 19 nt, synthetic construct
  misc_feature 1..19: note = siRNA Antisense Sequence
  source 1..19: mol_type = other RNA
tggacacagttaagagagc

SEQ ID NO: 869 - RNA, 19 nt, synthetic construct
  misc_feature 1..19: note = siRNA Sense Sequence
  source 1..19: mol_type = other RNA
taactgtgtccactccttc

SEQ ID NO: 870 - RNA, 19 nt, synthetic construct
  misc_feature 1..19: note = siRNA Antisense Sequence
  source 1..19: mol_type = other RNA
gaaggagtggacacagtta

SEQ ID NO: 871 - RNA, 19 nt, synthetic construct
  misc_feature 1..19: note = siRNA Sense Sequence
  source 1..19: mol_type = other RNA
aactgtgtccactccttca

SEQ ID NO: 872 - RNA, 19 nt, synthetic construct
  misc_feature 1..19: note = siRNA Antisense Sequence
  source 1..19: mol_type = other RNA
tgaaggagtggacacagtt

SEQ ID NO: 873 - RNA, 19 nt, synthetic construct
  misc_feature 1..19: note = siRNA Sense Sequence
  source 1..19: mol_type = other RNA
actgtgtccactccttcat

SEQ ID NO: 874 - RNA, 19 nt, synthetic construct
  misc_feature 1..19: note = siRNA Antisense Sequence
  source 1..19: mol_type = other RNA
atgaaggagtggacacagt

SEQ ID NO: 875 - RNA, 19 nt, synthetic construct
  misc_feature 1..19: note = siRNA Sense Sequence
  source 1..19: mol_type = other RNA
tgtgtccactccttcatgg

SEQ ID NO: 876 - RNA, 19 nt, synthetic construct
  misc_feature 1..19: note = siRNA Antisense Sequence
  source 1..19: mol_type = other RNA
ccatgaaggagtggacaca

SEQ ID NO: 877 - RNA, 19 nt, synthetic construct
  misc_feature 1..19: note = siRNA Sense Sequence
  source 1..19: mol_type = other RNA
gtgtccactccttcatggt

SEQ ID NO: 878 - RNA, 19 nt, synthetic construct
  misc_feature 1..19: note = siRNA Antisense Sequence
  source 1..19: mol_type = other RNA
accatgaaggagtggacac

SEQ ID NO: 879 - RNA, 19 nt, synthetic construct
  misc_feature 1..19: note = siRNA Sense Sequence
  source 1..19: mol_type = other RNA
tgtccactccttcatggtg

SEQ ID NO: 880 - RNA, 19 nt, synthetic construct
  misc_feature 1..19: note = siRNA Antisense Sequence
  source 1..19: mol_type = other RNA
caccatgaaggagtggaca

SEQ ID NO: 881 - RNA, 19 nt, synthetic construct
  misc_feature 1..19: note = siRNA Sense Sequence
  source 1..19: mol_type = other RNA
gtccactccttcatggtgt

SEQ ID NO: 882 - RNA, 19 nt, synthetic construct
  misc_feature 1..19: note = siRNA Antisense Sequence
  source 1..19: mol_type = other RNA
acaccatgaaggagtggac

SEQ ID NO: 883 - RNA, 19 nt, synthetic construct
  misc_feature 1..19: note = siRNA Sense Sequence
  source 1..19: mol_type = other RNA
tccactccttcatggtgtc

SEQ ID NO: 884 - RNA, 19 nt, synthetic construct
  misc_feature 1..19: note = siRNA Antisense Sequence
  source 1..19: mol_type = other RNA
gacaccatgaaggagtgga

SEQ ID NO: 885 - RNA, 19 nt, synthetic construct
  misc_feature 1..19: note = siRNA Sense Sequence
  source 1..19: mol_type = other RNA
ccactccttcatggtgtca

SEQ ID NO: 886 - RNA, 19 nt, synthetic construct
  misc_feature 1..19: note = siRNA Antisense Sequence
  source 1..19: mol_type = other RNA
tgacaccatgaaggagtgg

SEQ ID NO: 887 - RNA, 19 nt, synthetic construct
  misc_feature 1..19: note = siRNA Sense Sequence
  source 1..19: mol_type = other RNA
cactccttcatggtgtcag

SEQ ID NO: 888 - RNA, 19 nt, synthetic construct
  misc_feature 1..19: note = siRNA Antisense Sequence
  source 1..19: mol_type = other RNA
ctgacaccatgaaggagtg

SEQ ID NO: 889 - RNA, 19 nt, synthetic construct
  misc_feature 1..19: note = siRNA Sense Sequence
  source 1..19: mol_type = other RNA
actccttcatggtgtcaga

SEQ ID NO: 890 - RNA, 19 nt, synthetic construct
  misc_feature 1..19: note = siRNA Antisense Sequence
  source 1..19: mol_type = other RNA
tctgacaccatgaaggagt

SEQ ID NO: 891 - RNA, 19 nt, synthetic construct
  misc_feature 1..19: note = siRNA Sense Sequence
  source 1..19: mol_type = other RNA
agcactgaagcatctccaa

SEQ ID NO: 892 - RNA, 19 nt, synthetic construct
  misc_feature 1..19: note = siRNA Antisense Sequence
  source 1..19: mol_type = other RNA
ttggagatgcttcagtgct

SEQ ID NO: 893 - RNA, 19 nt, synthetic construct
  misc_feature 1..19: note = siRNA Sense Sequence
  source 1..19: mol_type = other RNA
gcactgaagcatctccaaa

SEQ ID NO: 894 - RNA, 19 nt, synthetic construct
  misc_feature 1..19: note = siRNA Antisense Sequence
  source 1..19: mol_type = other RNA
tttggagatgcttcagtgc

SEQ ID NO: 895 - RNA, 19 nt, synthetic construct
  misc_feature 1..19: note = siRNA Sense Sequence
  source 1..19: mol_type = other RNA
cactgaagcatctccaaaa

SEQ ID NO: 896 - RNA, 19 nt, synthetic construct
  misc_feature 1..19: note = siRNA Antisense Sequence
  source 1..19: mol_type = other RNA
ttttggagatgcttcagtg

SEQ ID NO: 897 - RNA, 19 nt, synthetic construct
  misc_feature 1..19: note = siRNA Sense Sequence
  source 1..19: mol_type = other RNA
aacgtagtgatgggacacc

SEQ ID NO: 898 - RNA, 19 nt, synthetic construct
  misc_feature 1..19: note = siRNA Antisense Sequence
  source 1..19: mol_type = other RNA
ggtgtcccatcactacgtt

SEQ ID NO: 899 - RNA, 19 nt, synthetic construct
  misc_feature 1..19: note = siRNA Sense Sequence
  source 1..19: mol_type = other RNA
acgtagtgatgggacacca

SEQ ID NO: 900 - RNA, 19 nt, synthetic construct
  misc_feature 1..19: note = siRNA Antisense Sequence
  source 1..19: mol_type = other RNA
tggtgtcccatcactacgt

SEQ ID NO: 901 - RNA, 19 nt, synthetic construct
  misc_feature 1..19: note = siRNA Sense Sequence
  source 1..19: mol_type = other RNA
ggacaccatttccttggaa

SEQ ID NO: 902 - RNA, 19 nt, synthetic construct
  misc_feature 1..19: note = siRNA Antisense Sequence
  source 1..19: mol_type = other RNA
ttccaaggaaatggtgtcc

SEQ ID NO: 903 - RNA, 19 nt, synthetic construct
  misc_feature 1..19: note = siRNA Sense Sequence
  source 1..19: mol_type = other RNA
gacaccatttccttggaat

SEQ ID NO: 904 - RNA, 19 nt, synthetic construct
  misc_feature 1..19: note = siRNA Antisense Sequence
  source 1..19: mol_type = other RNA
attccaaggaaatggtgtc

SEQ ID NO: 905 - RNA, 19 nt, synthetic construct
  misc_feature 1..19: note = siRNA Sense Sequence
  source 1..19: mol_type = other RNA
acaccatttccttggaata

SEQ ID NO: 906 - RNA, 19 nt, synthetic construct
  misc_feature 1..19: note = siRNA Antisense Sequence
  source 1..19: mol_type = other RNA
tattccaaggaaatggtgt

SEQ ID NO: 907 - RNA, 19 nt, synthetic construct
  misc_feature 1..19: note = siRNA Sense Sequence
  source 1..19: mol_type = other RNA
caccatttccttggaataa

SEQ ID NO: 908 - RNA, 19 nt, synthetic construct
  misc_feature 1..19: note = siRNA Antisense Sequence
  source 1..19: mol_type = other RNA
ttattccaaggaaatggtg

SEQ ID NO: 909 - RNA, 19 nt, synthetic construct
  misc_feature 1..19: note = siRNA Sense Sequence
  source 1..19: mol_type = other RNA
ccatttccttggaataaaa

SEQ ID NO: 910 - RNA, 19 nt, synthetic construct
  misc_feature 1..19: note = siRNA Antisense Sequence
  source 1..19: mol_type = other RNA
ttttattccaaggaaatgg

SEQ ID NO: 911 - RNA, 19 nt, synthetic construct
  misc_feature 1..19: note = siRNA Sense Sequence
  source 1..19: mol_type = other RNA
ttccttggaataaaatacg

SEQ ID NO: 912 - RNA, 19 nt, synthetic construct
  misc_feature 1..19: note = siRNA Antisense Sequence
  source 1..19: mol_type = other RNA
cgtattttattccaaggaa

SEQ ID NO: 913 - RNA, 19 nt, synthetic construct
  misc_feature 1..19: note = siRNA Sense Sequence
  source 1..19: mol_type = other RNA
tccttggaataaaatacga

SEQ ID NO: 914 - RNA, 19 nt, synthetic construct
  misc_feature 1..19: note = siRNA Antisense Sequence
  source 1..19: mol_type = other RNA
tcgtattttattccaagga

SEQ ID NO: 915 - RNA, 19 nt, synthetic construct
  misc_feature 1..19: note = siRNA Sense Sequence
  source 1..19: mol_type = other RNA
ccttggaataaaatacgac

SEQ ID NO: 916 - RNA, 19 nt, synthetic construct
  misc_feature 1..19: note = siRNA Antisense Sequence
  source 1..19: mol_type = other RNA
gtcgtattttattccaagg

SEQ ID NO: 917 - RNA, 19 nt, synthetic construct
  misc_feature 1..19: note = siRNA Sense Sequence
  source 1..19: mol_type = other RNA
tggaataaaatacgacttc

SEQ ID NO: 918 - RNA, 19 nt, synthetic construct
  misc_feature 1..19: note = siRNA Antisense Sequence
  source 1..19: mol_type = other RNA
gaagtcgtattttattcca

SEQ ID NO: 919 - RNA, 19 nt, synthetic construct
  misc_feature 1..19: note = siRNA Sense Sequence
  source 1..19: mol_type = other RNA
gaataaaatacgacttcct

SEQ ID NO: 920 - RNA, 19 nt, synthetic construct
  misc_feature 1..19: note = siRNA Antisense Sequence
  source 1..19: mol_type = other RNA
aggaagtcgtattttattc

SEQ ID NO: 921 - RNA, 19 nt, synthetic construct
  misc_feature 1..19: note = siRNA Sense Sequence
  source 1..19: mol_type = other RNA
gtcatcccagttcattatg

SEQ ID NO: 922 - RNA, 19 nt, synthetic construct
  misc_feature 1..19: note = siRNA Antisense Sequence
  source 1..19: mol_type = other RNA
cataatgaactgggatgac

SEQ ID NO: 923 - RNA, 19 nt, synthetic construct
  misc_feature 1..19: note = siRNA Sense Sequence
  source 1..19: mol_type = other RNA
cccagttcattatgatctc

SEQ ID NO: 924 - RNA, 19 nt, synthetic construct
  misc_feature 1..19: note = siRNA Antisense Sequence
  source 1..19: mol_type = other RNA
gagatcataatgaactggg

SEQ ID NO: 925 - RNA, 19 nt, synthetic construct
  misc_feature 1..19: note = siRNA Sense Sequence
  source 1..19: mol_type = other RNA
ccagttcattatgatctct

SEQ ID NO: 926 - RNA, 19 nt, synthetic construct
  misc_feature 1..19: note = siRNA Antisense Sequence
  source 1..19: mol_type = other RNA
agagatcataatgaactgg

SEQ ID NO: 927 - RNA, 19 nt, synthetic construct
  misc_feature 1..19: note = siRNA Sense Sequence
  source 1..19: mol_type = other RNA
cagttcattatgatctctt

SEQ ID NO: 928 - RNA, 19 nt, synthetic construct
  misc_feature 1..19: note = siRNA Antisense Sequence
  source 1..19: mol_type = other RNA
aagagatcataatgaactg

SEQ ID NO: 929 - RNA, 19 nt, synthetic construct
  misc_feature 1..19: note = siRNA Sense Sequence
  source 1..19: mol_type = other RNA
taccacgctgaccttctgg

SEQ ID NO: 930 - RNA, 19 nt, synthetic construct
  misc_feature 1..19: note = siRNA Antisense Sequence
  source 1..19: mol_type = other RNA
ccagaaggtcagcgtggta

SEQ ID NO: 931 - RNA, 19 nt, synthetic construct
  misc_feature 1..19: note = siRNA Sense Sequence
  source 1..19: mol_type = other RNA
accacgctgaccttctggg

SEQ ID NO: 932 - RNA, 19 nt, synthetic construct
  misc_feature 1..19: note = siRNA Antisense Sequence
  source 1..19: mol_type = other RNA
cccagaaggtcagcgtggt

SEQ ID NO: 933 - RNA, 19 nt, synthetic construct
  misc_feature 1..19: note = siRNA Sense Sequence
  source 1..19: mol_type = other RNA
aatcacagccagtcagccc

SEQ ID NO: 934 - RNA, 19 nt, synthetic construct
  misc_feature 1..19: note = siRNA Antisense Sequence
  source 1..19: mol_type = other RNA
gggctgactggctgtgatt

SEQ ID NO: 935 - RNA, 19 nt, synthetic construct
  misc_feature 1..19: note = siRNA Sense Sequence
  source 1..19: mol_type = other RNA
atcacagccagtcagccca

SEQ ID NO: 936 - RNA, 19 nt, synthetic construct
  misc_feature 1..19: note = siRNA Antisense Sequence
  source 1..19: mol_type = other RNA
tgggctgactggctgtgat

SEQ ID NO: 937 - RNA, 19 nt, synthetic construct
  misc_feature 1..19: note = siRNA Sense Sequence
  source 1..19: mol_type = other RNA
caccagcaccatcatcctg

SEQ ID NO: 938 - RNA, 19 nt, synthetic construct
  misc_feature 1..19: note = siRNA Antisense Sequence
  source 1..19: mol_type = other RNA
caggatgatggtgctggtg

SEQ ID NO: 939 - RNA, 19 nt, synthetic construct
  misc_feature 1..19: note = siRNA Sense Sequence
  source 1..19: mol_type = other RNA
accagcaccatcatcctgc

SEQ ID NO: 940 - RNA, 19 nt, synthetic construct
  misc_feature 1..19: note = siRNA Antisense Sequence
  source 1..19: mol_type = other RNA
gcaggatgatggtgctggt

SEQ ID NO: 941 - RNA, 19 nt, synthetic construct
  misc_feature 1..19: note = siRNA Sense Sequence
  source 1..19: mol_type = other RNA
ccagcaccatcatcctgca

SEQ ID NO: 942 - RNA, 19 nt, synthetic construct
  misc_feature 1..19: note = siRNA Antisense Sequence
  source 1..19: mol_type = other RNA
tgcaggatgatggtgctgg

SEQ ID NO: 943 - RNA, 19 nt, synthetic construct
  misc_feature 1..19: note = siRNA Sense Sequence
  source 1..19: mol_type = other RNA
cagcaccatcatcctgcat

SEQ ID NO: 944 - RNA, 19 nt, synthetic construct
  misc_feature 1..19: note = siRNA Antisense Sequence
  source 1..19: mol_type = other RNA
atgcaggatgatggtgctg

SEQ ID NO: 945 - RNA, 19 nt, synthetic construct
  misc_feature 1..19: note = siRNA Sense Sequence
  source 1..19: mol_type = other RNA
agcaccatcatcctgcata

SEQ ID NO: 946 - RNA, 19 nt, synthetic construct
  misc_feature 1..19: note = siRNA Antisense Sequence
  source 1..19: mol_type = other RNA
tatgcaggatgatggtgct

SEQ ID NO: 947 - RNA, 19 nt, synthetic construct
  misc_feature 1..19: note = siRNA Sense Sequence
  source 1..19: mol_type = other RNA
gcaccatcatcctgcatag

SEQ ID NO: 948 - RNA, 19 nt, synthetic construct
  misc_feature 1..19: note = siRNA Antisense Sequence
  source 1..19: mol_type = other RNA
ctatgcaggatgatggtgc

SEQ ID NO: 949 - RNA, 19 nt, synthetic construct
  misc_feature 1..19: note = siRNA Sense Sequence
  source 1..19: mol_type = other RNA
caccatcatcctgcatagt

SEQ ID NO: 950 - RNA, 19 nt, synthetic construct
  misc_feature 1..19: note = siRNA Antisense Sequence
  source 1..19: mol_type = other RNA
actatgcaggatgatggtg

SEQ ID NO: 951 - RNA, 19 nt, synthetic construct
  misc_feature 1..19: note = siRNA Sense Sequence
  source 1..19: mol_type = other RNA
accatcatcctgcatagtc

SEQ ID NO: 952 - RNA, 19 nt, synthetic construct
  misc_feature 1..19: note = siRNA Antisense Sequence
  source 1..19: mol_type = other RNA
gactatgcaggatgatggt

SEQ ID NO: 953 - RNA, 19 nt, synthetic construct
  misc_feature 1..19: note = siRNA Sense Sequence
  source 1..19: mol_type = other RNA
ccatcatcctgcatagtca

SEQ ID NO: 954 - RNA, 19 nt, synthetic construct
  misc_feature 1..19: note = siRNA Antisense Sequence
  source 1..19: mol_type = other RNA
tgactatgcaggatgatgg

SEQ ID NO: 955 - RNA, 19 nt, synthetic construct
  misc_feature 1..19: note = siRNA Sense Sequence
  source 1..19: mol_type = other RNA
catcctgcatagtcaccac

SEQ ID NO: 956 - RNA, 19 nt, synthetic construct
  misc_feature 1..19: note = siRNA Antisense Sequence
  source 1..19: mol_type = other RNA
gtggtgactatgcaggatg

SEQ ID NO: 957 - RNA, 19 nt, synthetic construct
  misc_feature 1..19: note = siRNA Sense Sequence
  source 1..19: mol_type = other RNA
tagtcaccacctgcagata

SEQ ID NO: 958 - RNA, 19 nt, synthetic construct
  misc_feature 1..19: note = siRNA Antisense Sequence
  source 1..19: mol_type = other RNA
tatctgcaggtggtgacta

SEQ ID NO: 959 - RNA, 19 nt, synthetic construct
  misc_feature 1..19: note = siRNA Sense Sequence
  source 1..19: mol_type = other RNA
agtcaccacctgcagatat

SEQ ID NO: 960 - RNA, 19 nt, synthetic construct
  misc_feature 1..19: note = siRNA Antisense Sequence
  source 1..19: mol_type = other RNA
atatctgcaggtggtgact

SEQ ID NO: 961 - RNA, 19 nt, synthetic construct
  misc_feature 1..19: note = siRNA Sense Sequence
  source 1..19: mol_type = other RNA
accacctgcagatatctag

SEQ ID NO: 962 - RNA, 19 nt, synthetic construct
  misc_feature 1..19: note = siRNA Antisense Sequence
  source 1..19: mol_type = other RNA
ctagatatctgcaggtggt

SEQ ID NO: 963 - RNA, 19 nt, synthetic construct
  misc_feature 1..19: note = siRNA Sense Sequence
  source 1..19: mol_type = other RNA
ccacctgcagatatctagg

SEQ ID NO: 964 - RNA, 19 nt, synthetic construct
  misc_feature 1..19: note = siRNA Antisense Sequence
  source 1..19: mol_type = other RNA
cctagatatctgcaggtgg

SEQ ID NO: 965 - RNA, 19 nt, synthetic construct
  misc_feature 1..19: note = siRNA Sense Sequence
  source 1..19: mol_type = other RNA
cacctgcagatatctaggg

SEQ ID NO: 966 - RNA, 19 nt, synthetic construct
  misc_feature 1..19: note = siRNA Antisense Sequence
  source 1..19: mol_type = other RNA
ccctagatatctgcaggtg

SEQ ID NO: 967 - RNA, 19 nt, synthetic construct
  misc_feature 1..19: note = siRNA Sense Sequence
  source 1..19: mol_type = other RNA
acctgcagatatctagggc

SEQ ID NO: 968 - RNA, 19 nt, synthetic construct
  misc_feature 1..19: note = siRNA Antisense Sequence
  source 1..19: mol_type = other RNA
gccctagatatctgcaggt

SEQ ID NO: 969 - RNA, 19 nt, synthetic construct
  misc_feature 1..19: note = siRNA Sense Sequence
  source 1..19: mol_type = other RNA
cctgcagatatctagggcc

SEQ ID NO: 970 - RNA, 19 nt, synthetic construct
  misc_feature 1..19: note = siRNA Antisense Sequence
  source 1..19: mol_type = other RNA
ggccctagatatctgcagg

SEQ ID NO: 971 - RNA, 19 nt, synthetic construct
  misc_feature 1..19: note = siRNA Sense Sequence
  source 1..19: mol_type = other RNA
caaattgcactgctggctc

SEQ ID NO: 972 - RNA, 19 nt, synthetic construct
  misc_feature 1..19: note = siRNA Antisense Sequence
  source 1..19: mol_type = other RNA
gagccagcagtgcaatttg

SEQ ID NO: 973 - RNA, 19 nt, synthetic construct
  misc_feature 1..19: note = siRNA Sense Sequence
  source 1..19: mol_type = other RNA
tccttgtcgggctcccgta

SEQ ID NO: 974 - RNA, 19 nt, synthetic construct
  misc_feature 1..19: note = siRNA Antisense Sequence
  source 1..19: mol_type = other RNA
tacgggagcccgacaagga

SEQ ID NO: 975 - RNA, 19 nt, synthetic construct
  misc_feature 1..19: note = siRNA Sense Sequence
  source 1..19: mol_type = other RNA
cttgtcgggctcccgtaca

SEQ ID NO: 976 - RNA, 19 nt, synthetic construct
  misc_feature 1..19: note = siRNA Antisense Sequence
  source 1..19: mol_type = other RNA
tgtacgggagcccgacaag

SEQ ID NO: 977 - RNA, 19 nt, synthetic construct
  misc_feature 1..19: note = siRNA Sense Sequence
  source 1..19: mol_type = other RNA
cacagttgtcattcactat

SEQ ID NO: 978 - RNA, 19 nt, synthetic construct
  misc_feature 1..19: note = siRNA Antisense Sequence
  source 1..19: mol_type = other RNA
atagtgaatgacaactgtg

SEQ ID NO: 979 - RNA, 19 nt, synthetic construct
  misc_feature 1..19: note = siRNA Sense Sequence
  source 1..19: mol_type = other RNA
acagttgtcattcactatg

SEQ ID NO: 980 - RNA, 19 nt, synthetic construct
  misc_feature 1..19: note = siRNA Antisense Sequence
  source 1..19: mol_type = other RNA
catagtgaatgacaactgt

SEQ ID NO: 981 - RNA, 19 nt, synthetic construct
  misc_feature 1..19: note = siRNA Sense Sequence
  source 1..19: mol_type = other RNA
cagttgtcattcactatgc

SEQ ID NO: 982 - RNA, 19 nt, synthetic construct
  misc_feature 1..19: note = siRNA Antisense Sequence
  source 1..19: mol_type = other RNA
gcatagtgaatgacaactg

SEQ ID NO: 983 - RNA, 19 nt, synthetic construct
  misc_feature 1..19: note = siRNA Sense Sequence
  source 1..19: mol_type = other RNA
agttgtcattcactatgct

SEQ ID NO: 984 - RNA, 19 nt, synthetic construct
  misc_feature 1..19: note = siRNA Antisense Sequence
  source 1..19: mol_type = other RNA
agcatagtgaatgacaact

SEQ ID NO: 985 - RNA, 19 nt, synthetic construct
  misc_feature 1..19: note = siRNA Sense Sequence
  source 1..19: mol_type = other RNA
gttgtcattcactatgctg

SEQ ID NO: 986 - RNA, 19 nt, synthetic construct
  misc_feature 1..19: note = siRNA Antisense Sequence
  source 1..19: mol_type = other RNA
cagcatagtgaatgacaac

SEQ ID NO: 987 - RNA, 19 nt, synthetic construct
  misc_feature 1..19: note = siRNA Sense Sequence
  source 1..19: mol_type = other RNA
cattcactatgctggcaat

SEQ ID NO: 988 - RNA, 19 nt, synthetic construct
  misc_feature 1..19: note = siRNA Antisense Sequence
  source 1..19: mol_type = other RNA
attgccagcatagtgaatg

SEQ ID NO: 989 - RNA, 19 nt, synthetic construct
  misc_feature 1..19: note = siRNA Sense Sequence
  source 1..19: mol_type = other RNA
attcactatgctggcaatc

SEQ ID NO: 990 - RNA, 19 nt, synthetic construct
  misc_feature 1..19: note = siRNA Antisense Sequence
  source 1..19: mol_type = other RNA
gattgccagcatagtgaat

SEQ ID NO: 991 - RNA, 19 nt, synthetic construct
  misc_feature 1..19: note = siRNA Sense Sequence
  source 1..19: mol_type = other RNA
ttcactatgctggcaatct

SEQ ID NO: 992 - RNA, 19 nt, synthetic construct
  misc_feature 1..19: note = siRNA Antisense Sequence
  source 1..19: mol_type = other RNA
agattgccagcatagtgaa

SEQ ID NO: 993 - RNA, 19 nt, synthetic construct
  misc_feature 1..19: note = siRNA Sense Sequence
  source 1..19: mol_type = other RNA
tcactatgctggcaatctt

SEQ ID NO: 994 - RNA, 19 nt, synthetic construct
  misc_feature 1..19: note = siRNA Antisense Sequence
  source 1..19: mol_type = other RNA
aagattgccagcatagtga

SEQ ID NO: 995 - RNA, 19 nt, synthetic construct
  misc_feature 1..19: note = siRNA Sense Sequence
  source 1..19: mol_type = other RNA
cactatgctggcaatcttt

SEQ ID NO: 996 - RNA, 19 nt, synthetic construct
  misc_feature 1..19: note = siRNA Antisense Sequence
  source 1..19: mol_type = other RNA
aaagattgccagcatagtg

SEQ ID NO: 997 - RNA, 19 nt, synthetic construct
  misc_feature 1..19: note = siRNA Sense Sequence
  source 1..19: mol_type = other RNA
actatgctggcaatctttc

SEQ ID NO: 998 - RNA, 19 nt, synthetic construct
  misc_feature 1..19: note = siRNA Antisense Sequence
  source 1..19: mol_type = other RNA
gaaagattgccagcatagt

SEQ ID NO: 999 - RNA, 19 nt, synthetic construct
  misc_feature 1..19: note = siRNA Sense Sequence
  source 1..19: mol_type = other RNA
agactttccacggatttta

SEQ ID NO: 1000 - RNA, 19 nt, synthetic construct
  misc_feature 1..19: note = siRNA Antisense Sequence
  source 1..19: mol_type = other RNA
taaaatccgtggaaagtct

SEQ ID NO: 1001 - RNA, 19 nt, synthetic construct
  misc_feature 1..19: note = siRNA Sense Sequence
  source 1..19: mol_type = other RNA
gactttccacggattttac

SEQ ID NO: 1002 - RNA, 19 nt, synthetic construct
  misc_feature 1..19: note = siRNA Antisense Sequence
  source 1..19: mol_type = other RNA
gtaaaatccgtggaaagtc

SEQ ID NO: 1003 - RNA, 19 nt, synthetic construct
  misc_feature 1..19: note = siRNA Sense Sequence
  source 1..19: mol_type = other RNA
actttccacggattttaca

SEQ ID NO: 1004 - RNA, 19 nt, synthetic construct
  misc_feature 1..19: note = siRNA Antisense Sequence
  source 1..19: mol_type = other RNA
tgtaaaatccgtggaaagt

SEQ ID NO: 1005 - RNA, 19 nt, synthetic construct
  misc_feature 1..19: note = siRNA Sense Sequence
  source 1..19: mol_type = other RNA
aactgaggatactagcatc

SEQ ID NO: 1006 - RNA, 19 nt, synthetic construct
  misc_feature 1..19: note = siRNA Antisense Sequence
  source 1..19: mol_type = other RNA
gatgctagtatcctcagtt

SEQ ID NO: 1007 - RNA, 19 nt, synthetic construct
  misc_feature 1..19: note = siRNA Sense Sequence
  source 1..19: mol_type = other RNA
actgaggatactagcatca

SEQ ID NO: 1008 - RNA, 19 nt, synthetic construct
  misc_feature 1..19: note = siRNA Antisense Sequence
  source 1..19: mol_type = other RNA
tgatgctagtatcctcagt

SEQ ID NO: 1009 - RNA, 19 nt, synthetic construct
  misc_feature 1..19: note = siRNA Sense Sequence
  source 1..19: mol_type = other RNA
ctgaggatactagcatcaa

SEQ ID NO: 1010 - RNA, 19 nt, synthetic construct
  misc_feature 1..19: note = siRNA Antisense Sequence
  source 1..19: mol_type = other RNA
ttgatgctagtatcctcag

SEQ ID NO: 1011 - RNA, 19 nt, synthetic construct
  misc_feature 1..19: note = siRNA Sense Sequence
  source 1..19: mol_type = other RNA
tgaggatactagcatcaac

SEQ ID NO: 1012 - RNA, 19 nt, synthetic construct
  misc_feature 1..19: note = siRNA Antisense Sequence
  source 1..19: mol_type = other RNA
gttgatgctagtatcctca

SEQ ID NO: 1013 - RNA, 19 nt, synthetic construct
  misc_feature 1..19: note = siRNA Sense Sequence
  source 1..19: mol_type = other RNA
tgcagctagaatggccttt

SEQ ID NO: 1014 - RNA, 19 nt, synthetic construct
  misc_feature 1..19: note = siRNA Antisense Sequence
  source 1..19: mol_type = other RNA
aaaggccattctagctgca

SEQ ID NO: 1015 - RNA, 19 nt, synthetic construct
  misc_feature 1..19: note = siRNA Sense Sequence
  source 1..19: mol_type = other RNA
aatggcctttccctgcttt

SEQ ID NO: 1016 - RNA, 19 nt, synthetic construct
  misc_feature 1..19: note = siRNA Antisense Sequence
  source 1..19: mol_type = other RNA
aaagcagggaaaggccatt

SEQ ID NO: 1017 - RNA, 19 nt, synthetic construct
  misc_feature 1..19: note = siRNA Sense Sequence
  source 1..19: mol_type = other RNA
gcctttccctgctttgatg

SEQ ID NO: 1018 - RNA, 19 nt, synthetic construct
  misc_feature 1..19: note = siRNA Antisense Sequence
  source 1..19: mol_type = other RNA
catcaaagcagggaaaggc

SEQ ID NO: 1019 - RNA, 19 nt, synthetic construct
  misc_feature 1..19: note = siRNA Sense Sequence
  source 1..19: mol_type = other RNA
ctttccctgctttgatgaa

SEQ ID NO: 1020 - RNA, 19 nt, synthetic construct
  misc_feature 1..19: note = siRNA Antisense Sequence
  source 1..19: mol_type = other RNA
ttcatcaaagcagggaaag

SEQ ID NO: 1021 - RNA, 19 nt, synthetic construct
  misc_feature 1..19: note = siRNA Sense Sequence
  source 1..19: mol_type = other RNA
acctgccttcaaagcaagt

SEQ ID NO: 1022 - RNA, 19 nt, synthetic construct
  misc_feature 1..19: note = siRNA Antisense Sequence
  source 1..19: mol_type = other RNA
acttgctttgaaggcaggt

SEQ ID NO: 1023 - RNA, 19 nt, synthetic construct
  misc_feature 1..19: note = siRNA Sense Sequence
  source 1..19: mol_type = other RNA
ctgccttcaaagcaagttt

SEQ ID NO: 1024 - RNA, 19 nt, synthetic construct
  misc_feature 1..19: note = siRNA Antisense Sequence
  source 1..19: mol_type = other RNA
aaacttgctttgaaggcag

SEQ ID NO: 1025 - RNA, 19 nt, synthetic construct
  misc_feature 1..19: note = siRNA Sense Sequence
  source 1..19: mol_type = other RNA
tgccttcaaagcaagtttc

SEQ ID NO: 1026 - RNA, 19 nt, synthetic construct
  misc_feature 1..19: note = siRNA Antisense Sequence
  source 1..19: mol_type = other RNA
gaaacttgctttgaaggca

SEQ ID NO: 1027 - RNA, 19 nt, synthetic construct
  misc_feature 1..19: note = siRNA Sense Sequence
  source 1..19: mol_type = other RNA
gccttcaaagcaagtttct

SEQ ID NO: 1028 - RNA, 19 nt, synthetic construct
  misc_feature 1..19: note = siRNA Antisense Sequence
  source 1..19: mol_type = other RNA
agaaacttgctttgaaggc

SEQ ID NO: 1029 - RNA, 19 nt, synthetic construct
  misc_feature 1..19: note = siRNA Sense Sequence
  source 1..19: mol_type = other RNA
caaagcaagtttctcaatc

SEQ ID NO: 1030 - RNA, 19 nt, synthetic construct
  misc_feature 1..19: note = siRNA Antisense Sequence
  source 1..19: mol_type = other RNA
gattgagaaacttgctttg

SEQ ID NO: 1031 - RNA, 19 nt, synthetic construct
  misc_feature 1..19: note = siRNA Sense Sequence
  source 1..19: mol_type = other RNA
aagcaagtttctcaatcaa

SEQ ID NO: 1032 - RNA, 19 nt, synthetic construct
  misc_feature 1..19: note = siRNA Antisense Sequence
  source 1..19: mol_type = other RNA
ttgattgagaaacttgctt

SEQ ID NO: 1033 - RNA, 19 nt, synthetic construct
  misc_feature 1..19: note = siRNA Sense Sequence
  source 1..19: mol_type = other RNA
agcaagtttctcaatcaaa

SEQ ID NO: 1034 - RNA, 19 nt, synthetic construct
  misc_feature 1..19: note = siRNA Antisense Sequence
  source 1..19: mol_type = other RNA
tttgattgagaaacttgct

SEQ ID NO: 1035 - RNA, 19 nt, synthetic construct
  misc_feature 1..19: note = siRNA Sense Sequence
  source 1..19: mol_type = other RNA
gcaagtttctcaatcaaaa

SEQ ID NO: 1036 - RNA, 19 nt, synthetic construct
  misc_feature 1..19: note = siRNA Antisense Sequence
  source 1..19: mol_type = other RNA
ttttgattgagaaacttgc

SEQ ID NO: 1037 - RNA, 19 nt, synthetic construct
  misc_feature 1..19: note = siRNA Sense Sequence
  source 1..19: mol_type = other RNA
gagccaaggcacctagcca

SEQ ID NO: 1038 - RNA, 19 nt, synthetic construct
  misc_feature 1..19: note = siRNA Antisense Sequence
  source 1..19: mol_type = other RNA
tggctaggtgccttggctc

SEQ ID NO: 1039 - RNA, 19 nt, synthetic construct
  misc_feature 1..19: note = siRNA Sense Sequence
  source 1..19: mol_type = other RNA
ggcacctagccatctccaa

SEQ ID NO: 1040 - RNA, 19 nt, synthetic construct
  misc_feature 1..19: note = siRNA Antisense Sequence
  source 1..19: mol_type = other RNA
ttggagatggctaggtgcc

SEQ ID NO: 1041 - RNA, 19 nt, synthetic construct
  misc_feature 1..19: note = siRNA Sense Sequence
  source 1..19: mol_type = other RNA
gcacctagccatctccaat

SEQ ID NO: 1042 - RNA, 19 nt, synthetic construct
  misc_feature 1..19: note = siRNA Antisense Sequence
  source 1..19: mol_type = other RNA
attggagatggctaggtgc

SEQ ID NO: 1043 - RNA, 19 nt, synthetic construct
  misc_feature 1..19: note = siRNA Sense Sequence
  source 1..19: mol_type = other RNA
cacctagccatctccaata

SEQ ID NO: 1044 - RNA, 19 nt, synthetic construct
  misc_feature 1..19: note = siRNA Antisense Sequence
  source 1..19: mol_type = other RNA
tattggagatggctaggtg

SEQ ID NO: 1045 - RNA, 19 nt, synthetic construct
  misc_feature 1..19: note = siRNA Sense Sequence
  source 1..19: mol_type = other RNA
acctagccatctccaatat

SEQ ID NO: 1046 - RNA, 19 nt, synthetic construct
  misc_feature 1..19: note = siRNA Antisense Sequence
  source 1..19: mol_type = other RNA
atattggagatggctaggt

SEQ ID NO: 1047 - RNA, 19 nt, synthetic construct
  misc_feature 1..19: note = siRNA Sense Sequence
  source 1..19: mol_type = other RNA
cctagccatctccaatatg

SEQ ID NO: 1048 - RNA, 19 nt, synthetic construct
  misc_feature 1..19: note = siRNA Antisense Sequence
  source 1..19: mol_type = other RNA
catattggagatggctagg

SEQ ID NO: 1049 - RNA, 19 nt, synthetic construct
  misc_feature 1..19: note = siRNA Sense Sequence
  source 1..19: mol_type = other RNA
ctagccatctccaatatgc

SEQ ID NO: 1050 - RNA, 19 nt, synthetic construct
  misc_feature 1..19: note = siRNA Antisense Sequence
  source 1..19: mol_type = other RNA
gcatattggagatggctag

SEQ ID NO: 1051 - RNA, 19 nt, synthetic construct
  misc_feature 1..19: note = siRNA Sense Sequence
  source 1..19: mol_type = other RNA
tagccatctccaatatgcc

SEQ ID NO: 1052 - RNA, 19 nt, synthetic construct
  misc_feature 1..19: note = siRNA Antisense Sequence
  source 1..19: mol_type = other RNA
ggcatattggagatggcta

SEQ ID NO: 1053 - RNA, 19 nt, synthetic construct
  misc_feature 1..19: note = siRNA Sense Sequence
  source 1..19: mol_type = other RNA
agccatctccaatatgcca

SEQ ID NO: 1054 - RNA, 19 nt, synthetic construct
  misc_feature 1..19: note = siRNA Antisense Sequence
  source 1..19: mol_type = other RNA
tggcatattggagatggct

SEQ ID NO: 1055 - RNA, 19 nt, synthetic construct
  misc_feature 1..19: note = siRNA Sense Sequence
  source 1..19: mol_type = other RNA
aaatctgtgactgttgctg

SEQ ID NO: 1056 - RNA, 19 nt, synthetic construct
  misc_feature 1..19: note = siRNA Antisense Sequence
  source 1..19: mol_type = other RNA
cagcaacagtcacagattt

SEQ ID NO: 1057 - RNA, 19 nt, synthetic construct
  misc_feature 1..19: note = siRNA Sense Sequence
  source 1..19: mol_type = other RNA
aatctgtgactgttgctga

SEQ ID NO: 1058 - RNA, 19 nt, synthetic construct
  misc_feature 1..19: note = siRNA Antisense Sequence
  source 1..19: mol_type = other RNA
tcagcaacagtcacagatt

SEQ ID NO: 1059 - RNA, 19 nt, synthetic construct
  misc_feature 1..19: note = siRNA Sense Sequence
  source 1..19: mol_type = other RNA
atctgtgactgttgctgaa

SEQ ID NO: 1060 - RNA, 19 nt, synthetic construct
  misc_feature 1..19: note = siRNA Antisense Sequence
  source 1..19: mol_type = other RNA
ttcagcaacagtcacagat

SEQ ID NO: 1061 - RNA, 19 nt, synthetic construct
  misc_feature 1..19: note = siRNA Sense Sequence
  source 1..19: mol_type = other RNA
tctgtgactgttgctgaag

SEQ ID NO: 1062 - RNA, 19 nt, synthetic construct
  misc_feature 1..19: note = siRNA Antisense Sequence
  source 1..19: mol_type = other RNA
cttcagcaacagtcacaga

SEQ ID NO: 1063 - RNA, 19 nt, synthetic construct
  misc_feature 1..19: note = siRNA Sense Sequence
  source 1..19: mol_type = other RNA
tgactgttgctgaaggact

SEQ ID NO: 1064 - RNA, 19 nt, synthetic construct
  misc_feature 1..19: note = siRNA Antisense Sequence
  source 1..19: mol_type = other RNA
agtccttcagcaacagtca

SEQ ID NO: 1065 - RNA, 19 nt, synthetic construct
  misc_feature 1..19: note = siRNA Sense Sequence
  source 1..19: mol_type = other RNA
actgttgctgaaggactca

SEQ ID NO: 1066 - RNA, 19 nt, synthetic construct
  misc_feature 1..19: note = siRNA Antisense Sequence
  source 1..19: mol_type = other RNA
tgagtccttcagcaacagt

SEQ ID NO: 1067 - RNA, 19 nt, synthetic construct
  misc_feature 1..19: note = siRNA Sense Sequence
  source 1..19: mol_type = other RNA
ctgttgctgaaggactcat

SEQ ID NO: 1068 - RNA, 19 nt, synthetic construct
  misc_feature 1..19: note = siRNA Antisense Sequence
  source 1..19: mol_type = other RNA
atgagtccttcagcaacag

SEQ ID NO: 1069 - RNA, 19 nt, synthetic construct
  misc_feature 1..19: note = siRNA Sense Sequence
  source 1..19: mol_type = other RNA
tgttgctgaaggactcata

SEQ ID NO: 1070 - RNA, 19 nt, synthetic construct
  misc_feature 1..19: note = siRNA Antisense Sequence
  source 1..19: mol_type = other RNA
tatgagtccttcagcaaca

SEQ ID NO: 1071 - RNA, 19 nt, synthetic construct
  misc_feature 1..19: note = siRNA Sense Sequence
  source 1..19: mol_type = other RNA
gttgctgaaggactcatag

SEQ ID NO: 1072 - RNA, 19 nt, synthetic construct
  misc_feature 1..19: note = siRNA Antisense Sequence
  source 1..19: mol_type = other RNA
ctatgagtccttcagcaac

SEQ ID NO: 1073 - RNA, 19 nt, synthetic construct
  misc_feature 1..19: note = siRNA Sense Sequence
  source 1..19: mol_type = other RNA
ttgctgaaggactcataga

SEQ ID NO: 1074 - RNA, 19 nt, synthetic construct
  misc_feature 1..19: note = siRNA Antisense Sequence
  source 1..19: mol_type = other RNA
tctatgagtccttcagcaa

SEQ ID NO: 1075 - RNA, 19 nt, synthetic construct
  misc_feature 1..19: note = siRNA Sense Sequence
  source 1..19: mol_type = other RNA
tgctgaaggactcatagaa

SEQ ID NO: 1076 - RNA, 19 nt, synthetic construct
  misc_feature 1..19: note = siRNA Antisense Sequence
  source 1..19: mol_type = other RNA
ttctatgagtccttcagca

SEQ ID NO: 1077 - RNA, 19 nt, synthetic construct
  misc_feature 1..19: note = siRNA Sense Sequence
  source 1..19: mol_type = other RNA
gctgaaggactcatagaag

SEQ ID NO: 1078 - RNA, 19 nt, synthetic construct
  misc_feature 1..19: note = siRNA Antisense Sequence
  source 1..19: mol_type = other RNA
cttctatgagtccttcagc

SEQ ID NO: 1079 - RNA, 19 nt, synthetic construct
  misc_feature 1..19: note = siRNA Sense Sequence
  source 1..19: mol_type = other RNA
ctgaaggactcatagaaga

SEQ ID NO: 1080 - RNA, 19 nt, synthetic construct
  misc_feature 1..19: note = siRNA Antisense Sequence
  source 1..19: mol_type = other RNA
tcttctatgagtccttcag

SEQ ID NO: 1081 - RNA, 19 nt, synthetic construct
  misc_feature 1..19: note = siRNA Sense Sequence
  source 1..19: mol_type = other RNA
tgaaggactcatagaagac

SEQ ID NO: 1082 - RNA, 19 nt, synthetic construct
  misc_feature 1..19: note = siRNA Antisense Sequence
  source 1..19: mol_type = other RNA
gtcttctatgagtccttca

SEQ ID NO: 1083 - RNA, 19 nt, synthetic construct
  misc_feature 1..19: note = siRNA Sense Sequence
  source 1..19: mol_type = other RNA
aaggactcatagaagacca

SEQ ID NO: 1084 - RNA, 19 nt, synthetic construct
  misc_feature 1..19: note = siRNA Antisense Sequence
  source 1..19: mol_type = other RNA
tggtcttctatgagtcctt

SEQ ID NO: 1085 - RNA, 19 nt, synthetic construct
  misc_feature 1..19: note = siRNA Sense Sequence
  source 1..19: mol_type = other RNA
aggactcatagaagaccat

SEQ ID NO: 1086 - RNA, 19 nt, synthetic construct
  misc_feature 1..19: note = siRNA Antisense Sequence
  source 1..19: mol_type = other RNA
atggtcttctatgagtcct

SEQ ID NO: 1087 - RNA, 19 nt, synthetic construct
  misc_feature 1..19: note = siRNA Sense Sequence
  source 1..19: mol_type = other RNA
ggactcatagaagaccatt

SEQ ID NO: 1088 - RNA, 19 nt, synthetic construct
  misc_feature 1..19: note = siRNA Antisense Sequence
  source 1..19: mol_type = other RNA
aatggtcttctatgagtcc

SEQ ID NO: 1089 - RNA, 19 nt, synthetic construct
  misc_feature 1..19: note = siRNA Sense Sequence
  source 1..19: mol_type = other RNA
gactcatagaagaccattt

SEQ ID NO: 1090 - RNA, 19 nt, synthetic construct
  misc_feature 1..19: note = siRNA Antisense Sequence
  source 1..19: mol_type = other RNA
aaatggtcttctatgagtc

SEQ ID NO: 1091 - RNA, 19 nt, synthetic construct
  misc_feature 1..19: note = siRNA Sense Sequence
  source 1..19: mol_type = other RNA
actcatagaagaccatttt

SEQ ID NO: 1092 - RNA, 19 nt, synthetic construct
  misc_feature 1..19: note = siRNA Antisense Sequence
  source 1..19: mol_type = other RNA
aaaatggtcttctatgagt

SEQ ID NO: 1093 - RNA, 19 nt, synthetic construct
  misc_feature 1..19: note = siRNA Sense Sequence
  source 1..19: mol_type = other RNA
ctcatagaagaccattttg

SEQ ID NO: 1094 - RNA, 19 nt, synthetic construct
  misc_feature 1..19: note = siRNA Antisense Sequence
  source 1..19: mol_type = other RNA
caaaatggtcttctatgag

SEQ ID NO: 1095 - RNA, 19 nt, synthetic construct
  misc_feature 1..19: note = siRNA Sense Sequence
  source 1..19: mol_type = other RNA
tcatagaagaccattttga

SEQ ID NO: 1096 - RNA, 19 nt, synthetic construct
  misc_feature 1..19: note = siRNA Antisense Sequence
  source 1..19: mol_type = other RNA
tcaaaatggtcttctatga

SEQ ID NO: 1097 - RNA, 19 nt, synthetic construct
  misc_feature 1..19: note = siRNA Sense Sequence
  source 1..19: mol_type = other RNA
catagaagaccattttgat

SEQ ID NO: 1098 - RNA, 19 nt, synthetic construct
  misc_feature 1..19: note = siRNA Antisense Sequence
  source 1..19: mol_type = other RNA
atcaaaatggtcttctatg

SEQ ID NO: 1099 - RNA, 19 nt, synthetic construct
  misc_feature 1..19: note = siRNA Sense Sequence
  source 1..19: mol_type = other RNA
atagaagaccattttgatg

SEQ ID NO: 1100 - RNA, 19 nt, synthetic construct
  misc_feature 1..19: note = siRNA Antisense Sequence
  source 1..19: mol_type = other RNA
catcaaaatggtcttctat

SEQ ID NO: 1101 - RNA, 19 nt, synthetic construct
  misc_feature 1..19: note = siRNA Sense Sequence
  source 1..19: mol_type = other RNA
tagaagaccattttgatgt

SEQ ID NO: 1102 - RNA, 19 nt, synthetic construct
  misc_feature 1..19: note = siRNA Antisense Sequence
  source 1..19: mol_type = other RNA
acatcaaaatggtcttcta

SEQ ID NO: 1103 - RNA, 19 nt, synthetic construct
  misc_feature 1..19: note = siRNA Sense Sequence
  source 1..19: mol_type = other RNA
agaagaccattttgatgtc

SEQ ID NO: 1104 - RNA, 19 nt, synthetic construct
  misc_feature 1..19: note = siRNA Antisense Sequence
  source 1..19: mol_type = other RNA
gacatcaaaatggtcttct

SEQ ID NO: 1105 - RNA, 19 nt, synthetic construct
  misc_feature 1..19: note = siRNA Sense Sequence
  source 1..19: mol_type = other RNA
tgatgtcactgtgaagatg

SEQ ID NO: 1106 - RNA, 19 nt, synthetic construct
  misc_feature 1..19: note = siRNA Antisense Sequence
  source 1..19: mol_type = other RNA
catcttcacagtgacatca

SEQ ID NO: 1107 - RNA, 19 nt, synthetic construct
  misc_feature 1..19: note = siRNA Sense Sequence
  source 1..19: mol_type = other RNA
gatgtcactgtgaagatga

SEQ ID NO: 1108 - RNA, 19 nt, synthetic construct
  misc_feature 1..19: note = siRNA Antisense Sequence
  source 1..19: mol_type = other RNA
tcatcttcacagtgacatc

SEQ ID NO: 1109 - RNA, 19 nt, synthetic construct
  misc_feature 1..19: note = siRNA Sense Sequence
  source 1..19: mol_type = other RNA
atgtcactgtgaagatgag

SEQ ID NO: 1110 - RNA, 19 nt, synthetic construct
  misc_feature 1..19: note = siRNA Antisense Sequence
  source 1..19: mol_type = other RNA
ctcatcttcacagtgacat

SEQ ID NO: 1111 - RNA, 19 nt, synthetic construct
  misc_feature 1..19: note = siRNA Sense Sequence
  source 1..19: mol_type = other RNA
tgtgaagatgagcacctat

SEQ ID NO: 1112 - RNA, 19 nt, synthetic construct
  misc_feature 1..19: note = siRNA Antisense Sequence
  source 1..19: mol_type = other RNA
ataggtgctcatcttcaca

SEQ ID NO: 1113 - RNA, 19 nt, synthetic construct
  misc_feature 1..19: note = siRNA Sense Sequence
  source 1..19: mol_type = other RNA
gtgaagatgagcacctatc

SEQ ID NO: 1114 - RNA, 19 nt, synthetic construct
  misc_feature 1..19: note = siRNA Antisense Sequence
  source 1..19: mol_type = other RNA
gataggtgctcatcttcac

SEQ ID NO: 1115 - RNA, 19 nt, synthetic construct
  misc_feature 1..19: note = siRNA Sense Sequence
  source 1..19: mol_type = other RNA
acctatctggtggccttca

SEQ ID NO: 1116 - RNA, 19 nt, synthetic construct
  misc_feature 1..19: note = siRNA Antisense Sequence
  source 1..19: mol_type = other RNA
tgaaggccaccagataggt

SEQ ID NO: 1117 - RNA, 19 nt, synthetic construct
  misc_feature 1..19: note = siRNA Sense Sequence
  source 1..19: mol_type = other RNA
cctatctggtggccttcat

SEQ ID NO: 1118 - RNA, 19 nt, synthetic construct
  misc_feature 1..19: note = siRNA Antisense Sequence
  source 1..19: mol_type = other RNA
atgaaggccaccagatagg

SEQ ID NO: 1119 - RNA, 19 nt, synthetic construct
  misc_feature 1..19: note = siRNA Sense Sequence
  source 1..19: mol_type = other RNA
ctatctggtggccttcatc

SEQ ID NO: 1120 - RNA, 19 nt, synthetic construct
  misc_feature 1..19: note = siRNA Antisense Sequence
  source 1..19: mol_type = other RNA
gatgaaggccaccagatag

SEQ ID NO: 1121 - RNA, 19 nt, synthetic construct
  misc_feature 1..19: note = siRNA Sense Sequence
  source 1..19: mol_type = other RNA
tatctggtggccttcatca

SEQ ID NO: 1122 - RNA, 19 nt, synthetic construct
  misc_feature 1..19: note = siRNA Antisense Sequence
  source 1..19: mol_type = other RNA
tgatgaaggccaccagata

SEQ ID NO: 1123 - RNA, 19 nt, synthetic construct
  misc_feature 1..19: note = siRNA Sense Sequence
  source 1..19: mol_type = other RNA
atctggtggccttcatcat

SEQ ID NO: 1124 - RNA, 19 nt, synthetic construct
  misc_feature 1..19: note = siRNA Antisense Sequence
  source 1..19: mol_type = other RNA
atgatgaaggccaccagat

SEQ ID NO: 1125 - RNA, 19 nt, synthetic construct
  misc_feature 1..19: note = siRNA Sense Sequence
  source 1..19: mol_type = other RNA
tctggtggccttcatcatt

SEQ ID NO: 1126 - RNA, 19 nt, synthetic construct
  misc_feature 1..19: note = siRNA Antisense Sequence
  source 1..19: mol_type = other RNA
aatgatgaaggccaccaga

SEQ ID NO: 1127 - RNA, 19 nt, synthetic construct
  misc_feature 1..19: note = siRNA Sense Sequence
  source 1..19: mol_type = other RNA
ctggtggccttcatcattt

SEQ ID NO: 1128 - RNA, 19 nt, synthetic construct
  misc_feature 1..19: note = siRNA Antisense Sequence
  source 1..19: mol_type = other RNA
aaatgatgaaggccaccag

SEQ ID NO: 1129 - RNA, 19 nt, synthetic construct
  misc_feature 1..19: note = siRNA Sense Sequence
  source 1..19: mol_type = other RNA
tggtggccttcatcatttc

SEQ ID NO: 1130 - RNA, 19 nt, synthetic construct
  misc_feature 1..19: note = siRNA Antisense Sequence
  source 1..19: mol_type = other RNA
gaaatgatgaaggccacca

SEQ ID NO: 1131 - RNA, 19 nt, synthetic construct
  misc_feature 1..19: note = siRNA Sense Sequence
  source 1..19: mol_type = other RNA
ggccttcatcatttcagat

SEQ ID NO: 1132 - RNA, 19 nt, synthetic construct
  misc_feature 1..19: note = siRNA Antisense Sequence
  source 1..19: mol_type = other RNA
atctgaaatgatgaaggcc

SEQ ID NO: 1133 - RNA, 19 nt, synthetic construct
  misc_feature 1..19: note = siRNA Sense Sequence
  source 1..19: mol_type = other RNA
gccttcatcatttcagatt

SEQ ID NO: 1134 - RNA, 19 nt, synthetic construct
  misc_feature 1..19: note = siRNA Antisense Sequence
  source 1..19: mol_type = other RNA
aatctgaaatgatgaaggc

SEQ ID NO: 1135 - RNA, 19 nt, synthetic construct
  misc_feature 1..19: note = siRNA Sense Sequence
  source 1..19: mol_type = other RNA
ccttcatcatttcagattt

SEQ ID NO: 1136 - RNA, 19 nt, synthetic construct
  misc_feature 1..19: note = siRNA Antisense Sequence
  source 1..19: mol_type = other RNA
aaatctgaaatgatgaagg

SEQ ID NO: 1137 - RNA, 19 nt, synthetic construct
  misc_feature 1..19: note = siRNA Sense Sequence
  source 1..19: mol_type = other RNA
agattttgagtctgtcagc

SEQ ID NO: 1138 - RNA, 19 nt, synthetic construct
  misc_feature 1..19: note = siRNA Antisense Sequence
  source 1..19: mol_type = other RNA
gctgacagactcaaaatct

SEQ ID NO: 1139 - RNA, 19 nt, synthetic construct
  misc_feature 1..19: note = siRNA Sense Sequence
  source 1..19: mol_type = other RNA
tttgagtctgtcagcaaga

SEQ ID NO: 1140 - RNA, 19 nt, synthetic construct
  misc_feature 1..19: note = siRNA Antisense Sequence
  source 1..19: mol_type = other RNA
tcttgctgacagactcaaa

SEQ ID NO: 1141 - RNA, 19 nt, synthetic construct
  misc_feature 1..19: note = siRNA Sense Sequence
  source 1..19: mol_type = other RNA
ttgagtctgtcagcaagat

SEQ ID NO: 1142 - RNA, 19 nt, synthetic construct
  misc_feature 1..19: note = siRNA Antisense Sequence
  source 1..19: mol_type = other RNA
atcttgctgacagactcaa

SEQ ID NO: 1143 - RNA, 19 nt, synthetic construct
  misc_feature 1..19: note = siRNA Sense Sequence
  source 1..19: mol_type = other RNA
tgagtctgtcagcaagata

SEQ ID NO: 1144 - RNA, 19 nt, synthetic construct
  misc_feature 1..19: note = siRNA Antisense Sequence
  source 1..19: mol_type = other RNA
tatcttgctgacagactca

SEQ ID NO: 1145 - RNA, 19 nt, synthetic construct
  misc_feature 1..19: note = siRNA Sense Sequence
  source 1..19: mol_type = other RNA
gagtctgtcagcaagataa

SEQ ID NO: 1146 - RNA, 19 nt, synthetic construct
  misc_feature 1..19: note = siRNA Antisense Sequence
  source 1..19: mol_type = other RNA
ttatcttgctgacagactc

SEQ ID NO: 1147 - RNA, 19 nt, synthetic construct
  misc_feature 1..19: note = siRNA Sense Sequence
  source 1..19: mol_type = other RNA
agtctgtcagcaagataac

SEQ ID NO: 1148 - RNA, 19 nt, synthetic construct
  misc_feature 1..19: note = siRNA Antisense Sequence
  source 1..19: mol_type = other RNA
gttatcttgctgacagact

SEQ ID NO: 1149 - RNA, 19 nt, synthetic construct
  misc_feature 1..19: note = siRNA Sense Sequence
  source 1..19: mol_type = other RNA
gtctgtcagcaagataacc

SEQ ID NO: 1150 - RNA, 19 nt, synthetic construct
  misc_feature 1..19: note = siRNA Antisense Sequence
  source 1..19: mol_type = other RNA
ggttatcttgctgacagac

SEQ ID NO: 1151 - RNA, 19 nt, synthetic construct
  misc_feature 1..19: note = siRNA Sense Sequence
  source 1..19: mol_type = other RNA
tctgtcagcaagataacca

SEQ ID NO: 1152 - RNA, 19 nt, synthetic construct
  misc_feature 1..19: note = siRNA Antisense Sequence
  source 1..19: mol_type = other RNA
tggttatcttgctgacaga

SEQ ID NO: 1153 - RNA, 19 nt, synthetic construct
  misc_feature 1..19: note = siRNA Sense Sequence
  source 1..19: mol_type = other RNA
tgtcagcaagataaccaag

SEQ ID NO: 1154 - RNA, 19 nt, synthetic construct
  misc_feature 1..19: note = siRNA Antisense Sequence
  source 1..19: mol_type = other RNA
cttggttatcttgctgaca

SEQ ID NO: 1155 - RNA, 19 nt, synthetic construct
  misc_feature 1..19: note = siRNA Sense Sequence
  source 1..19: mol_type = other RNA
gtcagcaagataaccaaga

SEQ ID NO: 1156 - RNA, 19 nt, synthetic construct
  misc_feature 1..19: note = siRNA Antisense Sequence
  source 1..19: mol_type = other RNA
tcttggttatcttgctgac

SEQ ID NO: 1157 - RNA, 19 nt, synthetic construct
  misc_feature 1..19: note = siRNA Sense Sequence
  source 1..19: mol_type = other RNA
tcagcaagataaccaagag

SEQ ID NO: 1158 - RNA, 19 nt, synthetic construct
  misc_feature 1..19: note = siRNA Antisense Sequence
  source 1..19: mol_type = other RNA
ctcttggttatcttgctga

SEQ ID NO: 1159 - RNA, 19 nt, synthetic construct
  misc_feature 1..19: note = siRNA Sense Sequence
  source 1..19: mol_type = other RNA
cagcaagataaccaagagt

SEQ ID NO: 1160 - RNA, 19 nt, synthetic construct
  misc_feature 1..19: note = siRNA Antisense Sequence
  source 1..19: mol_type = other RNA
actcttggttatcttgctg

SEQ ID NO: 1161 - RNA, 19 nt, synthetic construct
  misc_feature 1..19: note = siRNA Sense Sequence
  source 1..19: mol_type = other RNA
agcaagataaccaagagtg

SEQ ID NO: 1162 - RNA, 19 nt, synthetic construct
  misc_feature 1..19: note = siRNA Antisense Sequence
  source 1..19: mol_type = other RNA
cactcttggttatcttgct

SEQ ID NO: 1163 - RNA, 19 nt, synthetic construct
  misc_feature 1..19: note = siRNA Sense Sequence
  source 1..19: mol_type = other RNA
gcaagataaccaagagtgg

SEQ ID NO: 1164 - RNA, 19 nt, synthetic construct
  misc_feature 1..19: note = siRNA Antisense Sequence
  source 1..19: mol_type = other RNA
ccactcttggttatcttgc

SEQ ID NO: 1165 - RNA, 19 nt, synthetic construct
  misc_feature 1..19: note = siRNA Sense Sequence
  source 1..19: mol_type = other RNA
caagataaccaagagtgga

SEQ ID NO: 1166 - RNA, 19 nt, synthetic construct
  misc_feature 1..19: note = siRNA Antisense Sequence
  source 1..19: mol_type = other RNA
tccactcttggttatcttg

SEQ ID NO: 1167 - RNA, 19 nt, synthetic construct
  misc_feature 1..19: note = siRNA Sense Sequence
  source 1..19: mol_type = other RNA
aagataaccaagagtggag

SEQ ID NO: 1168 - RNA, 19 nt, synthetic construct
  misc_feature 1..19: note = siRNA Antisense Sequence
  source 1..19: mol_type = other RNA
ctccactcttggttatctt

SEQ ID NO: 1169 - RNA, 19 nt, synthetic construct
  misc_feature 1..19: note = siRNA Sense Sequence
  source 1..19: mol_type = other RNA
taaccaagagtggagtcaa

SEQ ID NO: 1170 - RNA, 19 nt, synthetic construct
  misc_feature 1..19: note = siRNA Antisense Sequence
  source 1..19: mol_type = other RNA
ttgactccactcttggtta

SEQ ID NO: 1171 - RNA, 19 nt, synthetic construct
  misc_feature 1..19: note = siRNA Sense Sequence
  source 1..19: mol_type = other RNA
aaccaagagtggagtcaag

SEQ ID NO: 1172 - RNA, 19 nt, synthetic construct
  misc_feature 1..19: note = siRNA Antisense Sequence
  source 1..19: mol_type = other RNA
cttgactccactcttggtt

SEQ ID NO: 1173 - RNA, 19 nt, synthetic construct
  misc_feature 1..19: note = siRNA Sense Sequence
  source 1..19: mol_type = other RNA
accaagagtggagtcaagg

SEQ ID NO: 1174 - RNA, 19 nt, synthetic construct
  misc_feature 1..19: note = siRNA Antisense Sequence
  source 1..19: mol_type = other RNA
ccttgactccactcttggt

SEQ ID NO: 1175 - RNA, 19 nt, synthetic construct
  misc_feature 1..19: note = siRNA Sense Sequence
  source 1..19: mol_type = other RNA
ccaagagtggagtcaaggt

SEQ ID NO: 1176 - RNA, 19 nt, synthetic construct
  misc_feature 1..19: note = siRNA Antisense Sequence
  source 1..19: mol_type = other RNA
accttgactccactcttgg

SEQ ID NO: 1177 - RNA, 19 nt, synthetic construct
  misc_feature 1..19: note = siRNA Sense Sequence
  source 1..19: mol_type = other RNA
caagagtggagtcaaggtt

SEQ ID NO: 1178 - RNA, 19 nt, synthetic construct
  misc_feature 1..19: note = siRNA Antisense Sequence
  source 1..19: mol_type = other RNA
aaccttgactccactcttg

SEQ ID NO: 1179 - RNA, 19 nt, synthetic construct
  misc_feature 1..19: note = siRNA Sense Sequence
  source 1..19: mol_type = other RNA
aagagtggagtcaaggttt

SEQ ID NO: 1180 - RNA, 19 nt, synthetic construct
  misc_feature 1..19: note = siRNA Antisense Sequence
  source 1..19: mol_type = other RNA
aaaccttgactccactctt

SEQ ID NO: 1181 - RNA, 19 nt, synthetic construct
  misc_feature 1..19: note = siRNA Sense Sequence
  source 1..19: mol_type = other RNA
agagtggagtcaaggtttc

SEQ ID NO: 1182 - RNA, 19 nt, synthetic construct
  misc_feature 1..19: note = siRNA Antisense Sequence
  source 1..19: mol_type = other RNA
gaaaccttgactccactct

SEQ ID NO: 1183 - RNA, 19 nt, synthetic construct
  misc_feature 1..19: note = siRNA Sense Sequence
  source 1..19: mol_type = other RNA
gagtggagtcaaggtttct

SEQ ID NO: 1184 - RNA, 19 nt, synthetic construct
  misc_feature 1..19: note = siRNA Antisense Sequence
  source 1..19: mol_type = other RNA
agaaaccttgactccactc

SEQ ID NO: 1185 - RNA, 19 nt, synthetic construct
  misc_feature 1..19: note = siRNA Sense Sequence
  source 1..19: mol_type = other RNA
agtggagtcaaggtttctg

SEQ ID NO: 1186 - RNA, 19 nt, synthetic construct
  misc_feature 1..19: note = siRNA Antisense Sequence
  source 1..19: mol_type = other RNA
cagaaaccttgactccact

SEQ ID NO: 1187 - RNA, 19 nt, synthetic construct
  misc_feature 1..19: note = siRNA Sense Sequence
  source 1..19: mol_type = other RNA
gtggagtcaaggtttctgt

SEQ ID NO: 1188 - RNA, 19 nt, synthetic construct
  misc_feature 1..19: note = siRNA Antisense Sequence
  source 1..19: mol_type = other RNA
acagaaaccttgactccac

SEQ ID NO: 1189 - RNA, 19 nt, synthetic construct
  misc_feature 1..19: note = siRNA Sense Sequence
  source 1..19: mol_type = other RNA
tggagtcaaggtttctgtt

SEQ ID NO: 1190 - RNA, 19 nt, synthetic construct
  misc_feature 1..19: note = siRNA Antisense Sequence
  source 1..19: mol_type = other RNA
aacagaaaccttgactcca

SEQ ID NO: 1191 - RNA, 19 nt, synthetic construct
  misc_feature 1..19: note = siRNA Sense Sequence
  source 1..19: mol_type = other RNA
ggagtcaaggtttctgttt

SEQ ID NO: 1192 - RNA, 19 nt, synthetic construct
  misc_feature 1..19: note = siRNA Antisense Sequence
  source 1..19: mol_type = other RNA
aaacagaaaccttgactcc

SEQ ID NO: 1193 - RNA, 19 nt, synthetic construct
  misc_feature 1..19: note = siRNA Sense Sequence
  source 1..19: mol_type = other RNA
gagtcaaggtttctgttta

SEQ ID NO: 1194 - RNA, 19 nt, synthetic construct
  misc_feature 1..19: note = siRNA Antisense Sequence
  source 1..19: mol_type = other RNA
taaacagaaaccttgactc

SEQ ID NO: 1195 - RNA, 19 nt, synthetic construct
  misc_feature 1..19: note = siRNA Sense Sequence
  source 1..19: mol_type = other RNA
agtcaaggtttctgtttat

SEQ ID NO: 1196 - RNA, 19 nt, synthetic construct
  misc_feature 1..19: note = siRNA Antisense Sequence
  source 1..19: mol_type = other RNA
ataaacagaaaccttgact

SEQ ID NO: 1197 - RNA, 19 nt, synthetic construct
  misc_feature 1..19: note = siRNA Sense Sequence
  source 1..19: mol_type = other RNA
gtcaaggtttctgtttatg

SEQ ID NO: 1198 - RNA, 19 nt, synthetic construct
  misc_feature 1..19: note = siRNA Antisense Sequence
  source 1..19: mol_type = other RNA
cataaacagaaaccttgac

SEQ ID NO: 1199 - RNA, 19 nt, synthetic construct
  misc_feature 1..19: note = siRNA Sense Sequence
  source 1..19: mol_type = other RNA
tcaaggtttctgtttatgc

SEQ ID NO: 1200 - RNA, 19 nt, synthetic construct
  misc_feature 1..19: note = siRNA Antisense Sequence
  source 1..19: mol_type = other RNA
gcataaacagaaaccttga

SEQ ID NO: 1201 - RNA, 19 nt, synthetic construct
  misc_feature 1..19: note = siRNA Sense Sequence
  source 1..19: mol_type = other RNA
caaggtttctgtttatgct

SEQ ID NO: 1202 - RNA, 19 nt, synthetic construct
  misc_feature 1..19: note = siRNA Antisense Sequence
  source 1..19: mol_type = other RNA
agcataaacagaaaccttg

SEQ ID NO: 1203 - RNA, 19 nt, synthetic construct
  misc_feature 1..19: note = siRNA Sense Sequence
  source 1..19: mol_type = other RNA
aaggtttctgtttatgctg

SEQ ID NO: 1204 - RNA, 19 nt, synthetic construct
  misc_feature 1..19: note = siRNA Antisense Sequence
  source 1..19: mol_type = other RNA
cagcataaacagaaacctt

SEQ ID NO: 1205 - RNA, 19 nt, synthetic construct
  misc_feature 1..19: note = siRNA Sense Sequence
  source 1..19: mol_type = other RNA
aggtttctgtttatgctgt

SEQ ID NO: 1206 - RNA, 19 nt, synthetic construct
  misc_feature 1..19: note = siRNA Antisense Sequence
  source 1..19: mol_type = other RNA
acagcataaacagaaacct

SEQ ID NO: 1207 - RNA, 19 nt, synthetic construct
  misc_feature 1..19: note = siRNA Sense Sequence
  source 1..19: mol_type = other RNA
tttctgtttatgctgtgcc

SEQ ID NO: 1208 - RNA, 19 nt, synthetic construct
  misc_feature 1..19: note = siRNA Antisense Sequence
  source 1..19: mol_type = other RNA
ggcacagcataaacagaaa

SEQ ID NO: 1209 - RNA, 19 nt, synthetic construct
  misc_feature 1..19: note = siRNA Sense Sequence
  source 1..19: mol_type = other RNA
ttctgtttatgctgtgcca

SEQ ID NO: 1210 - RNA, 19 nt, synthetic construct
  misc_feature 1..19: note = siRNA Antisense Sequence
  source 1..19: mol_type = other RNA
tggcacagcataaacagaa

SEQ ID NO: 1211 - RNA, 19 nt, synthetic construct
  misc_feature 1..19: note = siRNA Sense Sequence
  source 1..19: mol_type = other RNA
ctgtttatgctgtgccaga

SEQ ID NO: 1212 - RNA, 19 nt, synthetic construct
  misc_feature 1..19: note = siRNA Antisense Sequence
  source 1..19: mol_type = other RNA
tctggcacagcataaacag

SEQ ID NO: 1213 - RNA, 19 nt, synthetic construct
  misc_feature 1..19: note = siRNA Sense Sequence
  source 1..19: mol_type = other RNA
tgtttatgctgtgccagac

SEQ ID NO: 1214 - RNA, 19 nt, synthetic construct
  misc_feature 1..19: note = siRNA Antisense Sequence
  source 1..19: mol_type = other RNA
gtctggcacagcataaaca

SEQ ID NO: 1215 - RNA, 19 nt, synthetic construct
  misc_feature 1..19: note = siRNA Sense Sequence
  source 1..19: mol_type = other RNA
gtttatgctgtgccagaca

SEQ ID NO: 1216 - RNA, 19 nt, synthetic construct
  misc_feature 1..19: note = siRNA Antisense Sequence
  source 1..19: mol_type = other RNA
tgtctggcacagcataaac

SEQ ID NO: 1217 - RNA, 19 nt, synthetic construct
  misc_feature 1..19: note = siRNA Sense Sequence
  source 1..19: mol_type = other RNA
atgcactggatgctgcggt

SEQ ID NO: 1218 - RNA, 19 nt, synthetic construct
  misc_feature 1..19: note = siRNA Antisense Sequence
  source 1..19: mol_type = other RNA
accgcagcatccagtgcat

SEQ ID NO: 1219 - RNA, 19 nt, synthetic construct
  misc_feature 1..19: note = siRNA Sense Sequence
  source 1..19: mol_type = other RNA
tgcactggatgctgcggtg

SEQ ID NO: 1220 - RNA, 19 nt, synthetic construct
  misc_feature 1..19: note = siRNA Antisense Sequence
  source 1..19: mol_type = other RNA
caccgcagcatccagtgca

SEQ ID NO: 1221 - RNA, 19 nt, synthetic construct
  misc_feature 1..19: note = siRNA Sense Sequence
  source 1..19: mol_type = other RNA
gcactggatgctgcggtga

SEQ ID NO: 1222 - RNA, 19 nt, synthetic construct
  misc_feature 1..19: note = siRNA Antisense Sequence
  source 1..19: mol_type = other RNA
tcaccgcagcatccagtgc

SEQ ID NO: 1223 - RNA, 19 nt, synthetic construct
  misc_feature 1..19: note = siRNA Sense Sequence
  source 1..19: mol_type = other RNA
cactggatgctgcggtgac

SEQ ID NO: 1224 - RNA, 19 nt, synthetic construct
  misc_feature 1..19: note = siRNA Antisense Sequence
  source 1..19: mol_type = other RNA
gtcaccgcagcatccagtg

SEQ ID NO: 1225 - RNA, 19 nt, synthetic construct
  misc_feature 1..19: note = siRNA Sense Sequence
  source 1..19: mol_type = other RNA
actggatgctgcggtgact

SEQ ID NO: 1226 - RNA, 19 nt, synthetic construct
  misc_feature 1..19: note = siRNA Antisense Sequence
  source 1..19: mol_type = other RNA
agtcaccgcagcatccagt

SEQ ID NO: 1227 - RNA, 19 nt, synthetic construct
  misc_feature 1..19: note = siRNA Sense Sequence
  source 1..19: mol_type = other RNA
ctggatgctgcggtgactc

SEQ ID NO: 1228 - RNA, 19 nt, synthetic construct
  misc_feature 1..19: note = siRNA Antisense Sequence
  source 1..19: mol_type = other RNA
gagtcaccgcagcatccag

SEQ ID NO: 1229 - RNA, 19 nt, synthetic construct
  misc_feature 1..19: note = siRNA Sense Sequence
  source 1..19: mol_type = other RNA
tggatgctgcggtgactct

SEQ ID NO: 1230 - RNA, 19 nt, synthetic construct
  misc_feature 1..19: note = siRNA Antisense Sequence
  source 1..19: mol_type = other RNA
agagtcaccgcagcatcca

SEQ ID NO: 1231 - RNA, 19 nt, synthetic construct
  misc_feature 1..19: note = siRNA Sense Sequence
  source 1..19: mol_type = other RNA
ggatgctgcggtgactctt

SEQ ID NO: 1232 - RNA, 19 nt, synthetic construct
  misc_feature 1..19: note = siRNA Antisense Sequence
  source 1..19: mol_type = other RNA
aagagtcaccgcagcatcc

SEQ ID NO: 1233 - RNA, 19 nt, synthetic construct
  misc_feature 1..19: note = siRNA Sense Sequence
  source 1..19: mol_type = other RNA
gatgctgcggtgactcttc

SEQ ID NO: 1234 - RNA, 19 nt, synthetic construct
  misc_feature 1..19: note = siRNA Antisense Sequence
  source 1..19: mol_type = other RNA
gaagagtcaccgcagcatc

SEQ ID NO: 1235 - RNA, 19 nt, synthetic construct
  misc_feature 1..19: note = siRNA Sense Sequence
  source 1..19: mol_type = other RNA
atgctgcggtgactcttct

SEQ ID NO: 1236 - RNA, 19 nt, synthetic construct
  misc_feature 1..19: note = siRNA Antisense Sequence
  source 1..19: mol_type = other RNA
agaagagtcaccgcagcat

SEQ ID NO: 1237 - RNA, 19 nt, synthetic construct
  misc_feature 1..19: note = siRNA Sense Sequence
  source 1..19: mol_type = other RNA
tgctgcggtgactcttcta

SEQ ID NO: 1238 - RNA, 19 nt, synthetic construct
  misc_feature 1..19: note = siRNA Antisense Sequence
  source 1..19: mol_type = other RNA
tagaagagtcaccgcagca

SEQ ID NO: 1239 - RNA, 19 nt, synthetic construct
  misc_feature 1..19: note = siRNA Sense Sequence
  source 1..19: mol_type = other RNA
gctgcggtgactcttctag

SEQ ID NO: 1240 - RNA, 19 nt, synthetic construct
  misc_feature 1..19: note = siRNA Antisense Sequence
  source 1..19: mol_type = other RNA
ctagaagagtcaccgcagc

SEQ ID NO: 1241 - RNA, 19 nt, synthetic construct
  misc_feature 1..19: note = siRNA Sense Sequence
  source 1..19: mol_type = other RNA
ctgcggtgactcttctaga

SEQ ID NO: 1242 - RNA, 19 nt, synthetic construct
  misc_feature 1..19: note = siRNA Antisense Sequence
  source 1..19: mol_type = other RNA
tctagaagagtcaccgcag

SEQ ID NO: 1243 - RNA, 19 nt, synthetic construct
  misc_feature 1..19: note = siRNA Sense Sequence
  source 1..19: mol_type = other RNA
tgcggtgactcttctagaa

SEQ ID NO: 1244 - RNA, 19 nt, synthetic construct
  misc_feature 1..19: note = siRNA Antisense Sequence
  source 1..19: mol_type = other RNA
ttctagaagagtcaccgca

SEQ ID NO: 1245 - RNA, 19 nt, synthetic construct
  misc_feature 1..19: note = siRNA Sense Sequence
  source 1..19: mol_type = other RNA
gcggtgactcttctagaat

SEQ ID NO: 1246 - RNA, 19 nt, synthetic construct
  misc_feature 1..19: note = siRNA Antisense Sequence
  source 1..19: mol_type = other RNA
attctagaagagtcaccgc

SEQ ID NO: 1247 - RNA, 19 nt, synthetic construct
  misc_feature 1..19: note = siRNA Sense Sequence
  source 1..19: mol_type = other RNA
cggtgactcttctagaatt

SEQ ID NO: 1248 - RNA, 19 nt, synthetic construct
  misc_feature 1..19: note = siRNA Antisense Sequence
  source 1..19: mol_type = other RNA
aattctagaagagtcaccg

SEQ ID NO: 1249 - RNA, 19 nt, synthetic construct
  misc_feature 1..19: note = siRNA Sense Sequence
  source 1..19: mol_type = other RNA
cttctagaattttatgagg

SEQ ID NO: 1250 - RNA, 19 nt, synthetic construct
  misc_feature 1..19: note = siRNA Antisense Sequence
  source 1..19: mol_type = other RNA
cctcataaaattctagaag

SEQ ID NO: 1251 - RNA, 19 nt, synthetic construct
  misc_feature 1..19: note = siRNA Sense Sequence
  source 1..19: mol_type = other RNA
caagatcttgctgctattc

SEQ ID NO: 1252 - RNA, 19 nt, synthetic construct
  misc_feature 1..19: note = siRNA Antisense Sequence
  source 1..19: mol_type = other RNA
gaatagcagcaagatcttg

SEQ ID NO: 1253 - RNA, 19 nt, synthetic construct
  misc_feature 1..19: note = siRNA Sense Sequence
  source 1..19: mol_type = other RNA
aagatcttgctgctattcc

SEQ ID NO: 1254 - RNA, 19 nt, synthetic construct
  misc_feature 1..19: note = siRNA Antisense Sequence
  source 1..19: mol_type = other RNA
ggaatagcagcaagatctt

SEQ ID NO: 1255 - RNA, 19 nt, synthetic construct
  misc_feature 1..19: note = siRNA Sense Sequence
  source 1..19: mol_type = other RNA
agatcttgctgctattccc

SEQ ID NO: 1256 - RNA, 19 nt, synthetic construct
  misc_feature 1..19: note = siRNA Antisense Sequence
  source 1..19: mol_type = other RNA
gggaatagcagcaagatct

SEQ ID NO: 1257 - RNA, 19 nt, synthetic construct
  misc_feature 1..19: note = siRNA Sense Sequence
  source 1..19: mol_type = other RNA
gatcttgctgctattcccg

SEQ ID NO: 1258 - RNA, 19 nt, synthetic construct
  misc_feature 1..19: note = siRNA Antisense Sequence
  source 1..19: mol_type = other RNA
cgggaatagcagcaagatc

SEQ ID NO: 1259 - RNA, 19 nt, synthetic construct
  misc_feature 1..19: note = siRNA Sense Sequence
  source 1..19: mol_type = other RNA
ttgctgctattcccgactt

SEQ ID NO: 1260 - RNA, 19 nt, synthetic construct
  misc_feature 1..19: note = siRNA Antisense Sequence
  source 1..19: mol_type = other RNA
aagtcgggaatagcagcaa

SEQ ID NO: 1261 - RNA, 19 nt, synthetic construct
  misc_feature 1..19: note = siRNA Sense Sequence
  source 1..19: mol_type = other RNA
tgctgctattcccgacttt

SEQ ID NO: 1262 - RNA, 19 nt, synthetic construct
  misc_feature 1..19: note = siRNA Antisense Sequence
  source 1..19: mol_type = other RNA
aaagtcgggaatagcagca

SEQ ID NO: 1263 - RNA, 19 nt, synthetic construct
  misc_feature 1..19: note = siRNA Sense Sequence
  source 1..19: mol_type = other RNA
gctgctattcccgactttc

SEQ ID NO: 1264 - RNA, 19 nt, synthetic construct
  misc_feature 1..19: note = siRNA Antisense Sequence
  source 1..19: mol_type = other RNA
gaaagtcgggaatagcagc

SEQ ID NO: 1265 - RNA, 19 nt, synthetic construct
  misc_feature 1..19: note = siRNA Sense Sequence
  source 1..19: mol_type = other RNA
ctttcagtctggtgctatg

SEQ ID NO: 1266 - RNA, 19 nt, synthetic construct
  misc_feature 1..19: note = siRNA Antisense Sequence
  source 1..19: mol_type = other RNA
catagcaccagactgaaag

SEQ ID NO: 1267 - RNA, 19 nt, synthetic construct
  misc_feature 1..19: note = siRNA Sense Sequence
  source 1..19: mol_type = other RNA
tttcagtctggtgctatgg

SEQ ID NO: 1268 - RNA, 19 nt, synthetic construct
  misc_feature 1..19: note = siRNA Antisense Sequence
  source 1..19: mol_type = other RNA
ccatagcaccagactgaaa

SEQ ID NO: 1269 - RNA, 19 nt, synthetic construct
  misc_feature 1..19: note = siRNA Sense Sequence
  source 1..19: mol_type = other RNA
ttcagtctggtgctatgga

SEQ ID NO: 1270 - RNA, 19 nt, synthetic construct
  misc_feature 1..19: note = siRNA Antisense Sequence
  source 1..19: mol_type = other RNA
tccatagcaccagactgaa

SEQ ID NO: 1271 - RNA, 19 nt, synthetic construct
  misc_feature 1..19: note = siRNA Sense Sequence
  source 1..19: mol_type = other RNA
tcagtctggtgctatggaa

SEQ ID NO: 1272 - RNA, 19 nt, synthetic construct
  misc_feature 1..19: note = siRNA Antisense Sequence
  source 1..19: mol_type = other RNA
ttccatagcaccagactga

SEQ ID NO: 1273 - RNA, 19 nt, synthetic construct
  misc_feature 1..19: note = siRNA Sense Sequence
  source 1..19: mol_type = other RNA
aatctgctctgttgtttga

SEQ ID NO: 1274 - RNA, 19 nt, synthetic construct
  misc_feature 1..19: note = siRNA Antisense Sequence
  source 1..19: mol_type = other RNA
tcaaacaacagagcagatt

SEQ ID NO: 1275 - RNA, 19 nt, synthetic construct
  misc_feature 1..19: note = siRNA Sense Sequence
  source 1..19: mol_type = other RNA
atctgctctgttgtttgat

SEQ ID NO: 1276 - RNA, 19 nt, synthetic construct
  misc_feature 1..19: note = siRNA Antisense Sequence
  source 1..19: mol_type = other RNA
atcaaacaacagagcagat

SEQ ID NO: 1277 - RNA, 19 nt, synthetic construct
  misc_feature 1..19: note = siRNA Sense Sequence
  source 1..19: mol_type = other RNA
tctgctctgttgtttgatg

SEQ ID NO: 1278 - RNA, 19 nt, synthetic construct
  misc_feature 1..19: note = siRNA Antisense Sequence
  source 1..19: mol_type = other RNA
catcaaacaacagagcaga

SEQ ID NO: 1279 - RNA, 19 nt, synthetic construct
  misc_feature 1..19: note = siRNA Sense Sequence
  source 1..19: mol_type = other RNA
ctgctctgttgtttgatgc

SEQ ID NO: 1280 - RNA, 19 nt, synthetic construct
  misc_feature 1..19: note = siRNA Antisense Sequence
  source 1..19: mol_type = other RNA
gcatcaaacaacagagcag

SEQ ID NO: 1281 - RNA, 19 nt, synthetic construct
  misc_feature 1..19: note = siRNA Sense Sequence
  source 1..19: mol_type = other RNA
aaaagtcttctgcatcaag

SEQ ID NO: 1282 - RNA, 19 nt, synthetic construct
  misc_feature 1..19: note = siRNA Antisense Sequence
  source 1..19: mol_type = other RNA
cttgatgcagaagactttt

SEQ ID NO: 1283 - RNA, 19 nt, synthetic construct
  misc_feature 1..19: note = siRNA Sense Sequence
  source 1..19: mol_type = other RNA
aagtcttctgcatcaagta

SEQ ID NO: 1284 - RNA, 19 nt, synthetic construct
  misc_feature 1..19: note = siRNA Antisense Sequence
  source 1..19: mol_type = other RNA
tacttgatgcagaagactt

SEQ ID NO: 1285 - RNA, 19 nt, synthetic construct
  misc_feature 1..19: note = siRNA Sense Sequence
  source 1..19: mol_type = other RNA
agtcttctgcatcaagtaa

SEQ ID NO: 1286 - RNA, 19 nt, synthetic construct
  misc_feature 1..19: note = siRNA Antisense Sequence
  source 1..19: mol_type = other RNA
ttacttgatgcagaagact

SEQ ID NO: 1287 - RNA, 19 nt, synthetic construct
  misc_feature 1..19: note = siRNA Sense Sequence
  source 1..19: mol_type = other RNA
gtcttctgcatcaagtaag

SEQ ID NO: 1288 - RNA, 19 nt, synthetic construct
  misc_feature 1..19: note = siRNA Antisense Sequence
  source 1..19: mol_type = other RNA
cttacttgatgcagaagac

SEQ ID NO: 1289 - RNA, 19 nt, synthetic construct
  misc_feature 1..19: note = siRNA Sense Sequence
  source 1..19: mol_type = other RNA
tcttctgcatcaagtaagc

SEQ ID NO: 1290 - RNA, 19 nt, synthetic construct
  misc_feature 1..19: note = siRNA Antisense Sequence
  source 1..19: mol_type = other RNA
gcttacttgatgcagaaga

SEQ ID NO: 1291 - RNA, 19 nt, synthetic construct
  misc_feature 1..19: note = siRNA Sense Sequence
  source 1..19: mol_type = other RNA
aacctggtcactatggaat

SEQ ID NO: 1292 - RNA, 19 nt, synthetic construct
  misc_feature 1..19: note = siRNA Antisense Sequence
  source 1..19: mol_type = other RNA
attccatagtgaccaggtt

SEQ ID NO: 1293 - RNA, 19 nt, synthetic construct
  misc_feature 1..19: note = siRNA Sense Sequence
  source 1..19: mol_type = other RNA
acctggtcactatggaatg

SEQ ID NO: 1294 - RNA, 19 nt, synthetic construct
  misc_feature 1..19: note = siRNA Antisense Sequence
  source 1..19: mol_type = other RNA
cattccatagtgaccaggt

SEQ ID NO: 1295 - RNA, 19 nt, synthetic construct
  misc_feature 1..19: note = siRNA Sense Sequence
  source 1..19: mol_type = other RNA
cctggtcactatggaatgg

SEQ ID NO: 1296 - RNA, 19 nt, synthetic construct
  misc_feature 1..19: note = siRNA Antisense Sequence
  source 1..19: mol_type = other RNA
ccattccatagtgaccagg

SEQ ID NO: 1297 - RNA, 19 nt, synthetic construct
  misc_feature 1..19: note = siRNA Sense Sequence
  source 1..19: mol_type = other RNA
ctggtcactatggaatggt

SEQ ID NO: 1298 - RNA, 19 nt, synthetic construct
  misc_feature 1..19: note = siRNA Antisense Sequence
  source 1..19: mol_type = other RNA
accattccatagtgaccag

SEQ ID NO: 1299 - RNA, 19 nt, synthetic construct
  misc_feature 1..19: note = siRNA Sense Sequence
  source 1..19: mol_type = other RNA
tggtcactatggaatggtg

SEQ ID NO: 1300 - RNA, 19 nt, synthetic construct
  misc_feature 1..19: note = siRNA Antisense Sequence
  source 1..19: mol_type = other RNA
caccattccatagtgacca

SEQ ID NO: 1301 - RNA, 19 nt, synthetic construct
  misc_feature 1..19: note = siRNA Sense Sequence
  source 1..19: mol_type = other RNA
ggtcactatggaatggtgg

SEQ ID NO: 1302 - RNA, 19 nt, synthetic construct
  misc_feature 1..19: note = siRNA Antisense Sequence
  source 1..19: mol_type = other RNA
ccaccattccatagtgacc

SEQ ID NO: 1303 - RNA, 19 nt, synthetic construct
  misc_feature 1..19: note = siRNA Sense Sequence
  source 1..19: mol_type = other RNA
gtcactatggaatggtgga

SEQ ID NO: 1304 - RNA, 19 nt, synthetic construct
  misc_feature 1..19: note = siRNA Antisense Sequence
  source 1..19: mol_type = other RNA
tccaccattccatagtgac

SEQ ID NO: 1305 - RNA, 19 nt, synthetic construct
  misc_feature 1..19: note = siRNA Sense Sequence
  source 1..19: mol_type = other RNA
tcactatggaatggtggaa

SEQ ID NO: 1306 - RNA, 19 nt, synthetic construct
  misc_feature 1..19: note = siRNA Antisense Sequence
  source 1..19: mol_type = other RNA
ttccaccattccatagtga

SEQ ID NO: 1307 - RNA, 19 nt, synthetic construct
  misc_feature 1..19: note = siRNA Sense Sequence
  source 1..19: mol_type = other RNA
cactatggaatggtggaat

SEQ ID NO: 1308 - RNA, 19 nt, synthetic construct
  misc_feature 1..19: note = siRNA Antisense Sequence
  source 1..19: mol_type = other RNA
attccaccattccatagtg

SEQ ID NO: 1309 - RNA, 19 nt, synthetic construct
  misc_feature 1..19: note = siRNA Sense Sequence
  source 1..19: mol_type = other RNA
actatggaatggtggaatg

SEQ ID NO: 1310 - RNA, 19 nt, synthetic construct
  misc_feature 1..19: note = siRNA Antisense Sequence
  source 1..19: mol_type = other RNA
cattccaccattccatagt

SEQ ID NO: 1311 - RNA, 19 nt, synthetic construct
  misc_feature 1..19: note = siRNA Sense Sequence
  source 1..19: mol_type = other RNA
tggaatggtggaatgatct

SEQ ID NO: 1312 - RNA, 19 nt, synthetic construct
  misc_feature 1..19: note = siRNA Antisense Sequence
  source 1..19: mol_type = other RNA
agatcattccaccattcca

SEQ ID NO: 1313 - RNA, 19 nt, synthetic construct
  misc_feature 1..19: note = siRNA Sense Sequence
  source 1..19: mol_type = other RNA
ggaatggtggaatgatctt

SEQ ID NO: 1314 - RNA, 19 nt, synthetic construct
  misc_feature 1..19: note = siRNA Antisense Sequence
  source 1..19: mol_type = other RNA
aagatcattccaccattcc

SEQ ID NO: 1315 - RNA, 19 nt, synthetic construct
  misc_feature 1..19: note = siRNA Sense Sequence
  source 1..19: mol_type = other RNA
gaatggtggaatgatcttt

SEQ ID NO: 1316 - RNA, 19 nt, synthetic construct
  misc_feature 1..19: note = siRNA Antisense Sequence
  source 1..19: mol_type = other RNA
aaagatcattccaccattc

SEQ ID NO: 1317 - RNA, 19 nt, synthetic construct
  misc_feature 1..19: note = siRNA Sense Sequence
  source 1..19: mol_type = other RNA
aatggtggaatgatctttg

SEQ ID NO: 1318 - RNA, 19 nt, synthetic construct
  misc_feature 1..19: note = siRNA Antisense Sequence
  source 1..19: mol_type = other RNA
caaagatcattccaccatt

SEQ ID NO: 1319 - RNA, 19 nt, synthetic construct
  misc_feature 1..19: note = siRNA Sense Sequence
  source 1..19: mol_type = other RNA
atggtggaatgatctttgg

SEQ ID NO: 1320 - RNA, 19 nt, synthetic construct
  misc_feature 1..19: note = siRNA Antisense Sequence
  source 1..19: mol_type = other RNA
ccaaagatcattccaccat

SEQ ID NO: 1321 - RNA, 19 nt, synthetic construct
  misc_feature 1..19: note = siRNA Sense Sequence
  source 1..19: mol_type = other RNA
tggtggaatgatctttggc

SEQ ID NO: 1322 - RNA, 19 nt, synthetic construct
  misc_feature 1..19: note = siRNA Antisense Sequence
  source 1..19: mol_type = other RNA
gccaaagatcattccacca

SEQ ID NO: 1323 - RNA, 19 nt, synthetic construct
  misc_feature 1..19: note = siRNA Sense Sequence
  source 1..19: mol_type = other RNA
ggtggaatgatctttggct

SEQ ID NO: 1324 - RNA, 19 nt, synthetic construct
  misc_feature 1..19: note = siRNA Antisense Sequence
  source 1..19: mol_type = other RNA
agccaaagatcattccacc

SEQ ID NO: 1325 - RNA, 19 nt, synthetic construct
  misc_feature 1..19: note = siRNA Sense Sequence
  source 1..19: mol_type = other RNA
gtggaatgatctttggcta

SEQ ID NO: 1326 - RNA, 19 nt, synthetic construct
  misc_feature 1..19: note = siRNA Antisense Sequence
  source 1..19: mol_type = other RNA
tagccaaagatcattccac

SEQ ID NO: 1327 - RNA, 19 nt, synthetic construct
  misc_feature 1..19: note = siRNA Sense Sequence
  source 1..19: mol_type = other RNA
tggaatgatctttggctaa

SEQ ID NO: 1328 - RNA, 19 nt, synthetic construct
  misc_feature 1..19: note = siRNA Antisense Sequence
  source 1..19: mol_type = other RNA
ttagccaaagatcattcca

SEQ ID NO: 1329 - RNA, 19 nt, synthetic construct
  misc_feature 1..19: note = siRNA Sense Sequence
  source 1..19: mol_type = other RNA
ggaatgatctttggctaaa

SEQ ID NO: 1330 - RNA, 19 nt, synthetic construct
  misc_feature 1..19: note = siRNA Antisense Sequence
  source 1..19: mol_type = other RNA
tttagccaaagatcattcc

SEQ ID NO: 1331 - RNA, 19 nt, synthetic construct
  misc_feature 1..19: note = siRNA Sense Sequence
  source 1..19: mol_type = other RNA
gaatgatctttggctaaat

SEQ ID NO: 1332 - RNA, 19 nt, synthetic construct
  misc_feature 1..19: note = siRNA Antisense Sequence
  source 1..19: mol_type = other RNA
atttagccaaagatcattc

SEQ ID NO: 1333 - RNA, 19 nt, synthetic construct
  misc_feature 1..19: note = siRNA Sense Sequence
  source 1..19: mol_type = other RNA
aatgatctttggctaaatg

SEQ ID NO: 1334 - RNA, 19 nt, synthetic construct
  misc_feature 1..19: note = siRNA Antisense Sequence
  source 1..19: mol_type = other RNA
catttagccaaagatcatt

SEQ ID NO: 1335 - RNA, 19 nt, synthetic construct
  misc_feature 1..19: note = siRNA Sense Sequence
  source 1..19: mol_type = other RNA
aatttatggagtttgtgtc

SEQ ID NO: 1336 - RNA, 19 nt, synthetic construct
  misc_feature 1..19: note = siRNA Antisense Sequence
  source 1..19: mol_type = other RNA
gacacaaactccataaatt

SEQ ID NO: 1337 - RNA, 19 nt, synthetic construct
  misc_feature 1..19: note = siRNA Sense Sequence
  source 1..19: mol_type = other RNA
atttatggagtttgtgtct

SEQ ID NO: 1338 - RNA, 19 nt, synthetic construct
  misc_feature 1..19: note = siRNA Antisense Sequence
  source 1..19: mol_type = other RNA
agacacaaactccataaat

SEQ ID NO: 1339 - RNA, 19 nt, synthetic construct
  misc_feature 1..19: note = siRNA Sense Sequence
  source 1..19: mol_type = other RNA
tttatggagtttgtgtctg

SEQ ID NO: 1340 - RNA, 19 nt, synthetic construct
  misc_feature 1..19: note = siRNA Antisense Sequence
  source 1..19: mol_type = other RNA
cagacacaaactccataaa

SEQ ID NO: 1341 - RNA, 19 nt, synthetic construct
  misc_feature 1..19: note = siRNA Sense Sequence
  source 1..19: mol_type = other RNA
ttatggagtttgtgtctgt

SEQ ID NO: 1342 - RNA, 19 nt, synthetic construct
  misc_feature 1..19: note = siRNA Antisense Sequence
  source 1..19: mol_type = other RNA
acagacacaaactccataa

SEQ ID NO: 1343 - RNA, 19 nt, synthetic construct
  misc_feature 1..19: note = siRNA Sense Sequence
  source 1..19: mol_type = other RNA
tatggagtttgtgtctgtc

SEQ ID NO: 1344 - RNA, 19 nt, synthetic construct
  misc_feature 1..19: note = siRNA Antisense Sequence
  source 1..19: mol_type = other RNA
gacagacacaaactccata

SEQ ID NO: 1345 - RNA, 19 nt, synthetic construct
  misc_feature 1..19: note = siRNA Sense Sequence
  source 1..19: mol_type = other RNA
atggagtttgtgtctgtca

SEQ ID NO: 1346 - RNA, 19 nt, synthetic construct
  misc_feature 1..19: note = siRNA Antisense Sequence
  source 1..19: mol_type = other RNA
tgacagacacaaactccat

SEQ ID NO: 1347 - RNA, 19 nt, synthetic construct
  misc_feature 1..19: note = siRNA Sense Sequence
  source 1..19: mol_type = other RNA
tggagtttgtgtctgtcag

SEQ ID NO: 1348 - RNA, 19 nt, synthetic construct
  misc_feature 1..19: note = siRNA Antisense Sequence
  source 1..19: mol_type = other RNA
ctgacagacacaaactcca

SEQ ID NO: 1349 - RNA, 19 nt, synthetic construct
  misc_feature 1..19: note = siRNA Sense Sequence
  source 1..19: mol_type = other RNA
ggagtttgtgtctgtcagt

SEQ ID NO: 1350 - RNA, 19 nt, synthetic construct
  misc_feature 1..19: note = siRNA Antisense Sequence
  source 1..19: mol_type = other RNA
actgacagacacaaactcc

SEQ ID NO: 1351 - RNA, 19 nt, synthetic construct
  misc_feature 1..19: note = siRNA Sense Sequence
  source 1..19: mol_type = other RNA
gagtttgtgtctgtcagtg

SEQ ID NO: 1352 - RNA, 19 nt, synthetic construct
  misc_feature 1..19: note = siRNA Antisense Sequence
  source 1..19: mol_type = other RNA
cactgacagacacaaactc

SEQ ID NO: 1353 - RNA, 19 nt, synthetic construct
  misc_feature 1..19: note = siRNA Sense Sequence
  source 1..19: mol_type = other RNA
agtttgtgtctgtcagtgt

SEQ ID NO: 1354 - RNA, 19 nt, synthetic construct
  misc_feature 1..19: note = siRNA Antisense Sequence
  source 1..19: mol_type = other RNA
acactgacagacacaaact

SEQ ID NO: 1355 - RNA, 19 nt, synthetic construct
  misc_feature 1..19: note = siRNA Sense Sequence
  source 1..19: mol_type = other RNA
cagtgtgacccatcctgaa

SEQ ID NO: 1356 - RNA, 19 nt, synthetic construct
  misc_feature 1..19: note = siRNA Antisense Sequence
  source 1..19: mol_type = other RNA
ttcaggatgggtcacactg

SEQ ID NO: 1357 - RNA, 19 nt, synthetic construct
  misc_feature 1..19: note = siRNA Sense Sequence
  source 1..19: mol_type = other RNA
gcaatggaggtagatgctt

SEQ ID NO: 1358 - RNA, 19 nt, synthetic construct
  misc_feature 1..19: note = siRNA Antisense Sequence
  source 1..19: mol_type = other RNA
aagcatctacctccattgc

SEQ ID NO: 1359 - RNA, 19 nt, synthetic construct
  misc_feature 1..19: note = siRNA Sense Sequence
  source 1..19: mol_type = other RNA
aggtagatgctttaaattc

SEQ ID NO: 1360 - RNA, 19 nt, synthetic construct
  misc_feature 1..19: note = siRNA Antisense Sequence
  source 1..19: mol_type = other RNA
gaatttaaagcatctacct

SEQ ID NO: 1361 - RNA, 19 nt, synthetic construct
  misc_feature 1..19: note = siRNA Sense Sequence
  source 1..19: mol_type = other RNA
ggtagatgctttaaattcc

SEQ ID NO: 1362 - RNA, 19 nt, synthetic construct
  misc_feature 1..19: note = siRNA Antisense Sequence
  source 1..19: mol_type = other RNA
ggaatttaaagcatctacc

SEQ ID NO: 1363 - RNA, 19 nt, synthetic construct
  misc_feature 1..19: note = siRNA Sense Sequence
  source 1..19: mol_type = other RNA
gtagatgctttaaattcct

SEQ ID NO: 1364 - RNA, 19 nt, synthetic construct
  misc_feature 1..19: note = siRNA Antisense Sequence
  source 1..19: mol_type = other RNA
aggaatttaaagcatctac

SEQ ID NO: 1365 - RNA, 19 nt, synthetic construct
  misc_feature 1..19: note = siRNA Sense Sequence
  source 1..19: mol_type = other RNA
tagatgctttaaattcctc

SEQ ID NO: 1366 - RNA, 19 nt, synthetic construct
  misc_feature 1..19: note = siRNA Antisense Sequence
  source 1..19: mol_type = other RNA
gaggaatttaaagcatcta

SEQ ID NO: 1367 - RNA, 19 nt, synthetic construct
  misc_feature 1..19: note = siRNA Sense Sequence
  source 1..19: mol_type = other RNA
cctgtgtctacacctgtgg

SEQ ID NO: 1368 - RNA, 19 nt, synthetic construct
  misc_feature 1..19: note = siRNA Antisense Sequence
  source 1..19: mol_type = other RNA
ccacaggtgtagacacagg

SEQ ID NO: 1369 - RNA, 19 nt, synthetic construct
  misc_feature 1..19: note = siRNA Sense Sequence
  source 1..19: mol_type = other RNA
tgtgtctacacctgtggaa

SEQ ID NO: 1370 - RNA, 19 nt, synthetic construct
  misc_feature 1..19: note = siRNA Antisense Sequence
  source 1..19: mol_type = other RNA
ttccacaggtgtagacaca

SEQ ID NO: 1371 - RNA, 19 nt, synthetic construct
  misc_feature 1..19: note = siRNA Sense Sequence
  source 1..19: mol_type = other RNA
tatgataagggagcttgta

SEQ ID NO: 1372 - RNA, 19 nt, synthetic construct
  misc_feature 1..19: note = siRNA Antisense Sequence
  source 1..19: mol_type = other RNA
tacaagctcccttatcata

SEQ ID NO: 1373 - RNA, 19 nt, synthetic construct
  misc_feature 1..19: note = siRNA Sense Sequence
  source 1..19: mol_type = other RNA
ataagggagcttgtattct

SEQ ID NO: 1374 - RNA, 19 nt, synthetic construct
  misc_feature 1..19: note = siRNA Antisense Sequence
  source 1..19: mol_type = other RNA
agaatacaagctcccttat

SEQ ID NO: 1375 - RNA, 19 nt, synthetic construct
  misc_feature 1..19: note = siRNA Sense Sequence
  source 1..19: mol_type = other RNA
taagggagcttgtattctg

SEQ ID NO: 1376 - RNA, 19 nt, synthetic construct
  misc_feature 1..19: note = siRNA Antisense Sequence
  source 1..19: mol_type = other RNA
cagaatacaagctccctta

SEQ ID NO: 1377 - RNA, 19 nt, synthetic construct
  misc_feature 1..19: note = siRNA Sense Sequence
  source 1..19: mol_type = other RNA
aagggagcttgtattctga

SEQ ID NO: 1378 - RNA, 19 nt, synthetic construct
  misc_feature 1..19: note = siRNA Antisense Sequence
  source 1..19: mol_type = other RNA
tcagaatacaagctccctt

SEQ ID NO: 1379 - RNA, 19 nt, synthetic construct
  misc_feature 1..19: note = siRNA Sense Sequence
  source 1..19: mol_type = other RNA
agggagcttgtattctgaa

SEQ ID NO: 1380 - RNA, 19 nt, synthetic construct
  misc_feature 1..19: note = siRNA Antisense Sequence
  source 1..19: mol_type = other RNA
ttcagaatacaagctccct

SEQ ID NO: 1381 - RNA, 19 nt, synthetic construct
  misc_feature 1..19: note = siRNA Sense Sequence
  source 1..19: mol_type = other RNA
attctgaatatgctaaggg

SEQ ID NO: 1382 - RNA, 19 nt, synthetic construct
  misc_feature 1..19: note = siRNA Antisense Sequence
  source 1..19: mol_type = other RNA
cccttagcatattcagaat

SEQ ID NO: 1383 - RNA, 19 nt, synthetic construct
  misc_feature 1..19: note = siRNA Sense Sequence
  source 1..19: mol_type = other RNA
gaatatgctaagggagtat

SEQ ID NO: 1384 - RNA, 19 nt, synthetic construct
  misc_feature 1..19: note = siRNA Antisense Sequence
  source 1..19: mol_type = other RNA
atactcccttagcatattc

SEQ ID NO: 1385 - RNA, 19 nt, synthetic construct
  misc_feature 1..19: note = siRNA Sense Sequence
  source 1..19: mol_type = other RNA
aatatgctaagggagtatc

SEQ ID NO: 1386 - RNA, 19 nt, synthetic construct
  misc_feature 1..19: note = siRNA Antisense Sequence
  source 1..19: mol_type = other RNA
gatactcccttagcatatt

SEQ ID NO: 1387 - RNA, 19 nt, synthetic construct
  misc_feature 1..19: note = siRNA Sense Sequence
  source 1..19: mol_type = other RNA
atatgctaagggagtatct

SEQ ID NO: 1388 - RNA, 19 nt, synthetic construct
  misc_feature 1..19: note = siRNA Antisense Sequence
  source 1..19: mol_type = other RNA
agatactcccttagcatat

SEQ ID NO: 1389 - RNA, 19 nt, synthetic construct
  misc_feature 1..19: note = siRNA Sense Sequence
  source 1..19: mol_type = other RNA
tatgctaagggagtatctt

SEQ ID NO: 1390 - RNA, 19 nt, synthetic construct
  misc_feature 1..19: note = siRNA Antisense Sequence
  source 1..19: mol_type = other RNA
aagatactcccttagcata

SEQ ID NO: 1391 - RNA, 19 nt, synthetic construct
  misc_feature 1..19: note = siRNA Sense Sequence
  source 1..19: mol_type = other RNA
gctgacgcatttaaaagtg

SEQ ID NO: 1392 - RNA, 19 nt, synthetic construct
  misc_feature 1..19: note = siRNA Antisense Sequence
  source 1..19: mol_type = other RNA
cacttttaaatgcgtcagc

SEQ ID NO: 1393 - RNA, 19 nt, synthetic construct
  misc_feature 1..19: note = siRNA Sense Sequence
  source 1..19: mol_type = other RNA
ctgacgcatttaaaagtgg

SEQ ID NO: 1394 - RNA, 19 nt, synthetic construct
  misc_feature 1..19: note = siRNA Antisense Sequence
  source 1..19: mol_type = other RNA
ccacttttaaatgcgtcag

SEQ ID NO: 1395 - RNA, 19 nt, synthetic construct
  misc_feature 1..19: note = siRNA Sense Sequence
  source 1..19: mol_type = other RNA
tgacgcatttaaaagtggt

SEQ ID NO: 1396 - RNA, 19 nt, synthetic construct
  misc_feature 1..19: note = siRNA Antisense Sequence
  source 1..19: mol_type = other RNA
accacttttaaatgcgtca

SEQ ID NO: 1397 - RNA, 19 nt, synthetic construct
  misc_feature 1..19: note = siRNA Sense Sequence
  source 1..19: mol_type = other RNA
gacgcatttaaaagtggta

SEQ ID NO: 1398 - RNA, 19 nt, synthetic construct
  misc_feature 1..19: note = siRNA Antisense Sequence
  source 1..19: mol_type = other RNA
taccacttttaaatgcgtc

SEQ ID NO: 1399 - RNA, 19 nt, synthetic construct
  misc_feature 1..19: note = siRNA Sense Sequence
  source 1..19: mol_type = other RNA
acgcatttaaaagtggtat

SEQ ID NO: 1400 - RNA, 19 nt, synthetic construct
  misc_feature 1..19: note = siRNA Antisense Sequence
  source 1..19: mol_type = other RNA
ataccacttttaaatgcgt

SEQ ID NO: 1401 - RNA, 19 nt, synthetic construct
  misc_feature 1..19: note = siRNA Sense Sequence
  source 1..19: mol_type = other RNA
cgcatttaaaagtggtatt

SEQ ID NO: 1402 - RNA, 19 nt, synthetic construct
  misc_feature 1..19: note = siRNA Antisense Sequence
  source 1..19: mol_type = other RNA
aataccacttttaaatgcg

SEQ ID NO: 1403 - RNA, 19 nt, synthetic construct
  misc_feature 1..19: note = siRNA Sense Sequence
  source 1..19: mol_type = other RNA
gcatttaaaagtggtattg

SEQ ID NO: 1404 - RNA, 19 nt, synthetic construct
  misc_feature 1..19: note = siRNA Antisense Sequence
  source 1..19: mol_type = other RNA
caataccacttttaaatgc

SEQ ID NO: 1405 - RNA, 19 nt, synthetic construct
  misc_feature 1..19: note = siRNA Sense Sequence
  source 1..19: mol_type = other RNA
aaagtggtattgtacagta

SEQ ID NO: 1406 - RNA, 19 nt, synthetic construct
  misc_feature 1..19: note = siRNA Antisense Sequence
  source 1..19: mol_type = other RNA
tactgtacaataccacttt

SEQ ID NO: 1407 - RNA, 19 nt, synthetic construct
  misc_feature 1..19: note = siRNA Sense Sequence
  source 1..19: mol_type = other RNA
aagtggtattgtacagtat

SEQ ID NO: 1408 - RNA, 19 nt, synthetic construct
  misc_feature 1..19: note = siRNA Antisense Sequence
  source 1..19: mol_type = other RNA
atactgtacaataccactt

SEQ ID NO: 1409 - RNA, 19 nt, synthetic construct
  misc_feature 1..19: note = siRNA Sense Sequence
  source 1..19: mol_type = other RNA
agtggtattgtacagtatc

SEQ ID NO: 1410 - RNA, 19 nt, synthetic construct
  misc_feature 1..19: note = siRNA Antisense Sequence
  source 1..19: mol_type = other RNA
gatactgtacaataccact

SEQ ID NO: 1411 - RNA, 19 nt, synthetic construct
  misc_feature 1..19: note = siRNA Sense Sequence
  source 1..19: mol_type = other RNA
gtggtattgtacagtatct

SEQ ID NO: 1412 - RNA, 19 nt, synthetic construct
  misc_feature 1..19: note = siRNA Antisense Sequence
  source 1..19: mol_type = other RNA
agatactgtacaataccac

SEQ ID NO: 1413 - RNA, 19 nt, synthetic construct
  misc_feature 1..19: note = siRNA Sense Sequence
  source 1..19: mol_type = other RNA
tggtattgtacagtatctc

SEQ ID NO: 1414 - RNA, 19 nt, synthetic construct
  misc_feature 1..19: note = siRNA Antisense Sequence
  source 1..19: mol_type = other RNA
gagatactgtacaatacca

SEQ ID NO: 1415 - RNA, 19 nt, synthetic construct
  misc_feature 1..19: note = siRNA Sense Sequence
  source 1..19: mol_type = other RNA
ggtattgtacagtatctcc

SEQ ID NO: 1416 - RNA, 19 nt, synthetic construct
  misc_feature 1..19: note = siRNA Antisense Sequence
  source 1..19: mol_type = other RNA
ggagatactgtacaatacc

SEQ ID NO: 1417 - RNA, 19 nt, synthetic construct
  misc_feature 1..19: note = siRNA Sense Sequence
  source 1..19: mol_type = other RNA
gtattgtacagtatctcca

SEQ ID NO: 1418 - RNA, 19 nt, synthetic construct
  misc_feature 1..19: note = siRNA Antisense Sequence
  source 1..19: mol_type = other RNA
tggagatactgtacaatac

SEQ ID NO: 1419 - RNA, 19 nt, synthetic construct
  misc_feature 1..19: note = siRNA Sense Sequence
  source 1..19: mol_type = other RNA
tattgtacagtatctccag

SEQ ID NO: 1420 - RNA, 19 nt, synthetic construct
  misc_feature 1..19: note = siRNA Antisense Sequence
  source 1..19: mol_type = other RNA
ctggagatactgtacaata

SEQ ID NO: 1421 - RNA, 19 nt, synthetic construct
  misc_feature 1..19: note = siRNA Sense Sequence
  source 1..19: mol_type = other RNA
attgtacagtatctccaga

SEQ ID NO: 1422 - RNA, 19 nt, synthetic construct
  misc_feature 1..19: note = siRNA Antisense Sequence
  source 1..19: mol_type = other RNA
tctggagatactgtacaat

SEQ ID NO: 1423 - RNA, 19 nt, synthetic construct
  misc_feature 1..19: note = siRNA Sense Sequence
  source 1..19: mol_type = other RNA
ttgtacagtatctccagaa

SEQ ID NO: 1424 - RNA, 19 nt, synthetic construct
  misc_feature 1..19: note = siRNA Antisense Sequence
  source 1..19: mol_type = other RNA
ttctggagatactgtacaa

SEQ ID NO: 1425 - RNA, 19 nt, synthetic construct
  misc_feature 1..19: note = siRNA Sense Sequence
  source 1..19: mol_type = other RNA
tgtacagtatctccagaag

SEQ ID NO: 1426 - RNA, 19 nt, synthetic construct
  misc_feature 1..19: note = siRNA Antisense Sequence
  source 1..19: mol_type = other RNA
cttctggagatactgtaca

SEQ ID NO: 1427 - RNA, 19 nt, synthetic construct
  misc_feature 1..19: note = siRNA Sense Sequence
  source 1..19: mol_type = other RNA
ctccagaagcatagctata

SEQ ID NO: 1428 - RNA, 19 nt, synthetic construct
  misc_feature 1..19: note = siRNA Antisense Sequence
  source 1..19: mol_type = other RNA
tatagctatgcttctggag

SEQ ID NO: 1429 - RNA, 19 nt, synthetic construct
  misc_feature 1..19: note = siRNA Sense Sequence
  source 1..19: mol_type = other RNA
tccagaagcatagctataa

SEQ ID NO: 1430 - RNA, 19 nt, synthetic construct
  misc_feature 1..19: note = siRNA Antisense Sequence
  source 1..19: mol_type = other RNA
ttatagctatgcttctgga

SEQ ID NO: 1431 - RNA, 19 nt, synthetic construct
  misc_feature 1..19: note = siRNA Sense Sequence
  source 1..19: mol_type = other RNA
ccagaagcatagctataaa

SEQ ID NO: 1432 - RNA, 19 nt, synthetic construct
  misc_feature 1..19: note = siRNA Antisense Sequence
  source 1..19: mol_type = other RNA
tttatagctatgcttctgg

SEQ ID NO: 1433 - RNA, 19 nt, synthetic construct
  misc_feature 1..19: note = siRNA Sense Sequence
  source 1..19: mol_type = other RNA
acgaggacctgtgggatag

SEQ ID NO: 1434 - RNA, 19 nt, synthetic construct
  misc_feature 1..19: note = siRNA Antisense Sequence
  source 1..19: mol_type = other RNA
ctatcccacaggtcctcgt

SEQ ID NO: 1435 - RNA, 19 nt, synthetic construct
  misc_feature 1..19: note = siRNA Sense Sequence
  source 1..19: mol_type = other RNA
cgaggacctgtgggatagt

SEQ ID NO: 1436 - RNA, 19 nt, synthetic construct
  misc_feature 1..19: note = siRNA Antisense Sequence
  source 1..19: mol_type = other RNA
actatcccacaggtcctcg

SEQ ID NO: 1437 - RNA, 19 nt, synthetic construct
  misc_feature 1..19: note = siRNA Sense Sequence
  source 1..19: mol_type = other RNA
gaggacctgtgggatagta

SEQ ID NO: 1438 - RNA, 19 nt, synthetic construct
  misc_feature 1..19: note = siRNA Antisense Sequence
  source 1..19: mol_type = other RNA
tactatcccacaggtcctc

SEQ ID NO: 1439 - RNA, 19 nt, synthetic construct
  misc_feature 1..19: note = siRNA Sense Sequence
  source 1..19: mol_type = other RNA
aggacctgtgggatagtat

SEQ ID NO: 1440 - RNA, 19 nt, synthetic construct
  misc_feature 1..19: note = siRNA Antisense Sequence
  source 1..19: mol_type = other RNA
atactatcccacaggtcct

SEQ ID NO: 1441 - RNA, 19 nt, synthetic construct
  misc_feature 1..19: note = siRNA Sense Sequence
  source 1..19: mol_type = other RNA
ggacctgtgggatagtatg

SEQ ID NO: 1442 - RNA, 19 nt, synthetic construct
  misc_feature 1..19: note = siRNA Antisense Sequence
  source 1..19: mol_type = other RNA
catactatcccacaggtcc

SEQ ID NO: 1443 - RNA, 19 nt, synthetic construct
  misc_feature 1..19: note = siRNA Sense Sequence
  source 1..19: mol_type = other RNA
gacctgtgggatagtatgg

SEQ ID NO: 1444 - RNA, 19 nt, synthetic construct
  misc_feature 1..19: note = siRNA Antisense Sequence
  source 1..19: mol_type = other RNA
ccatactatcccacaggtc

SEQ ID NO: 1445 - RNA, 19 nt, synthetic construct
  misc_feature 1..19: note = siRNA Sense Sequence
  source 1..19: mol_type = other RNA
acctgtgggatagtatggc

SEQ ID NO: 1446 - RNA, 19 nt, synthetic construct
  misc_feature 1..19: note = siRNA Antisense Sequence
  source 1..19: mol_type = other RNA
gccatactatcccacaggt

SEQ ID NO: 1447 - RNA, 19 nt, synthetic construct
  misc_feature 1..19: note = siRNA Sense Sequence
  source 1..19: mol_type = other RNA
cctgtgggatagtatggca

SEQ ID NO: 1448 - RNA, 19 nt, synthetic construct
  misc_feature 1..19: note = siRNA Antisense Sequence
  source 1..19: mol_type = other RNA
tgccatactatcccacagg

SEQ ID NO: 1449 - RNA, 19 nt, synthetic construct
  misc_feature 1..19: note = siRNA Sense Sequence
  source 1..19: mol_type = other RNA
ctgtgggatagtatggcaa

SEQ ID NO: 1450 - RNA, 19 nt, synthetic construct
  misc_feature 1..19: note = siRNA Antisense Sequence
  source 1..19: mol_type = other RNA
ttgccatactatcccacag

SEQ ID NO: 1451 - RNA, 19 nt, synthetic construct
  misc_feature 1..19: note = siRNA Sense Sequence
  source 1..19: mol_type = other RNA
tgtgggatagtatggcaag

SEQ ID NO: 1452 - RNA, 19 nt, synthetic construct
  misc_feature 1..19: note = siRNA Antisense Sequence
  source 1..19: mol_type = other RNA
cttgccatactatcccaca

SEQ ID NO: 1453 - RNA, 19 nt, synthetic construct
  misc_feature 1..19: note = siRNA Sense Sequence
  source 1..19: mol_type = other RNA
gtgggatagtatggcaagt

SEQ ID NO: 1454 - RNA, 19 nt, synthetic construct
  misc_feature 1..19: note = siRNA Antisense Sequence
  source 1..19: mol_type = other RNA
acttgccatactatcccac

SEQ ID NO: 1455 - RNA, 19 nt, synthetic construct
  misc_feature 1..19: note = siRNA Sense Sequence
  source 1..19: mol_type = other RNA
tgggatagtatggcaagta

SEQ ID NO: 1456 - RNA, 19 nt, synthetic construct
  misc_feature 1..19: note = siRNA Antisense Sequence
  source 1..19: mol_type = other RNA
tacttgccatactatccca

SEQ ID NO: 1457 - RNA, 19 nt, synthetic construct
  misc_feature 1..19: note = siRNA Sense Sequence
  source 1..19: mol_type = other RNA
gggatagtatggcaagtat

SEQ ID NO: 1458 - RNA, 19 nt, synthetic construct
  misc_feature 1..19: note = siRNA Antisense Sequence
  source 1..19: mol_type = other RNA
atacttgccatactatccc

SEQ ID NO: 1459 - RNA, 19 nt, synthetic construct
  misc_feature 1..19: note = siRNA Sense Sequence
  source 1..19: mol_type = other RNA
aagtatttgccctacagat

SEQ ID NO: 1460 - RNA, 19 nt, synthetic construct
  misc_feature 1..19: note = siRNA Antisense Sequence
  source 1..19: mol_type = other RNA
atctgtagggcaaatactt

SEQ ID NO: 1461 - RNA, 19 nt, synthetic construct
  misc_feature 1..19: note = siRNA Sense Sequence
  source 1..19: mol_type = other RNA
agtatttgccctacagatg

SEQ ID NO: 1462 - RNA, 19 nt, synthetic construct
  misc_feature 1..19: note = siRNA Antisense Sequence
  source 1..19: mol_type = other RNA
catctgtagggcaaatact

SEQ ID NO: 1463 - RNA, 19 nt, synthetic construct
  misc_feature 1..19: note = siRNA Sense Sequence
  source 1..19: mol_type = other RNA
gtatttgccctacagatgg

SEQ ID NO: 1464 - RNA, 19 nt, synthetic construct
  misc_feature 1..19: note = siRNA Antisense Sequence
  source 1..19: mol_type = other RNA
ccatctgtagggcaaatac

SEQ ID NO: 1465 - RNA, 19 nt, synthetic construct
  misc_feature 1..19: note = siRNA Sense Sequence
  source 1..19: mol_type = other RNA
tatttgccctacagatggt

SEQ ID NO: 1466 - RNA, 19 nt, synthetic construct
  misc_feature 1..19: note = siRNA Antisense Sequence
  source 1..19: mol_type = other RNA
accatctgtagggcaaata

SEQ ID NO: 1467 - RNA, 19 nt, synthetic construct
  misc_feature 1..19: note = siRNA Sense Sequence
  source 1..19: mol_type = other RNA
atttgccctacagatggtg

SEQ ID NO: 1468 - RNA, 19 nt, synthetic construct
  misc_feature 1..19: note = siRNA Antisense Sequence
  source 1..19: mol_type = other RNA
caccatctgtagggcaaat

SEQ ID NO: 1469 - RNA, 19 nt, synthetic construct
  misc_feature 1..19: note = siRNA Sense Sequence
  source 1..19: mol_type = other RNA
tttgccctacagatggtgt

SEQ ID NO: 1470 - RNA, 19 nt, synthetic construct
  misc_feature 1..19: note = siRNA Antisense Sequence
  source 1..19: mol_type = other RNA
acaccatctgtagggcaaa

SEQ ID NO: 1471 - RNA, 19 nt, synthetic construct
  misc_feature 1..19: note = siRNA Sense Sequence
  source 1..19: mol_type = other RNA
tggtgtaaaagggatggat

SEQ ID NO: 1472 - RNA, 19 nt, synthetic construct
  misc_feature 1..19: note = siRNA Antisense Sequence
  source 1..19: mol_type = other RNA
atccatcccttttacacca

SEQ ID NO: 1473 - RNA, 19 nt, synthetic construct
  misc_feature 1..19: note = siRNA Sense Sequence
  source 1..19: mol_type = other RNA
ggtgtaaaagggatggatg

SEQ ID NO: 1474 - RNA, 19 nt, synthetic construct
  misc_feature 1..19: note = siRNA Antisense Sequence
  source 1..19: mol_type = other RNA
catccatcccttttacacc

SEQ ID NO: 1475 - RNA, 19 nt, synthetic construct
  misc_feature 1..19: note = siRNA Sense Sequence
  source 1..19: mol_type = other RNA
gtgtaaaagggatggatgg

SEQ ID NO: 1476 - RNA, 19 nt, synthetic construct
  misc_feature 1..19: note = siRNA Antisense Sequence
  source 1..19: mol_type = other RNA
ccatccatcccttttacac

SEQ ID NO: 1477 - RNA, 19 nt, synthetic construct
  misc_feature 1..19: note = siRNA Sense Sequence
  source 1..19: mol_type = other RNA
tgtaaaagggatggatggc

SEQ ID NO: 1478 - RNA, 19 nt, synthetic construct
  misc_feature 1..19: note = siRNA Antisense Sequence
  source 1..19: mol_type = other RNA
gccatccatcccttttaca

SEQ ID NO: 1479 - RNA, 19 nt, synthetic construct
  misc_feature 1..19: note = siRNA Sense Sequence
  source 1..19: mol_type = other RNA
aagggatggatggcttttg

SEQ ID NO: 1480 - RNA, 19 nt, synthetic construct
  misc_feature 1..19: note = siRNA Antisense Sequence
  source 1..19: mol_type = other RNA
caaaagccatccatccctt

SEQ ID NO: 1481 - RNA, 19 nt, synthetic construct
  misc_feature 1..19: note = siRNA Sense Sequence
  source 1..19: mol_type = other RNA
agggatggatggcttttgc

SEQ ID NO: 1482 - RNA, 19 nt, synthetic construct
  misc_feature 1..19: note = siRNA Antisense Sequence
  source 1..19: mol_type = other RNA
gcaaaagccatccatccct

SEQ ID NO: 1483 - RNA, 19 nt, synthetic construct
  misc_feature 1..19: note = siRNA Sense Sequence
  source 1..19: mol_type = other RNA
gggatggatggcttttgct

SEQ ID NO: 1484 - RNA, 19 nt, synthetic construct
  misc_feature 1..19: note = siRNA Antisense Sequence
  source 1..19: mol_type = other RNA
agcaaaagccatccatccc

SEQ ID NO: 1485 - RNA, 19 nt, synthetic construct
  misc_feature 1..19: note = siRNA Sense Sequence
  source 1..19: mol_type = other RNA
gatggatggcttttgctct

SEQ ID NO: 1486 - RNA, 19 nt, synthetic construct
  misc_feature 1..19: note = siRNA Antisense Sequence
  source 1..19: mol_type = other RNA
agagcaaaagccatccatc

SEQ ID NO: 1487 - RNA, 19 nt, synthetic construct
  misc_feature 1..19: note = siRNA Sense Sequence
  source 1..19: mol_type = other RNA
atggatggcttttgctcta

SEQ ID NO: 1488 - RNA, 19 nt, synthetic construct
  misc_feature 1..19: note = siRNA Antisense Sequence
  source 1..19: mol_type = other RNA
tagagcaaaagccatccat

SEQ ID NO: 1489 - RNA, 19 nt, synthetic construct
  misc_feature 1..19: note = siRNA Sense Sequence
  source 1..19: mol_type = other RNA
tggatggcttttgctctag

SEQ ID NO: 1490 - RNA, 19 nt, synthetic construct
  misc_feature 1..19: note = siRNA Antisense Sequence
  source 1..19: mol_type = other RNA
ctagagcaaaagccatcca

SEQ ID NO: 1491 - RNA, 19 nt, synthetic construct
  misc_feature 1..19: note = siRNA Sense Sequence
  source 1..19: mol_type = other RNA
ggatggcttttgctctaga

SEQ ID NO: 1492 - RNA, 19 nt, synthetic construct
  misc_feature 1..19: note = siRNA Antisense Sequence
  source 1..19: mol_type = other RNA
tctagagcaaaagccatcc

SEQ ID NO: 1493 - RNA, 19 nt, synthetic construct
  misc_feature 1..19: note = siRNA Sense Sequence
  source 1..19: mol_type = other RNA
gatggcttttgctctagaa

SEQ ID NO: 1494 - RNA, 19 nt, synthetic construct
  misc_feature 1..19: note = siRNA Antisense Sequence
  source 1..19: mol_type = other RNA
ttctagagcaaaagccatc

SEQ ID NO: 1495 - RNA, 19 nt, synthetic construct
  misc_feature 1..19: note = siRNA Sense Sequence
  source 1..19: mol_type = other RNA
atggcttttgctctagaag

SEQ ID NO: 1496 - RNA, 19 nt, synthetic construct
  misc_feature 1..19: note = siRNA Antisense Sequence
  source 1..19: mol_type = other RNA
cttctagagcaaaagccat

SEQ ID NO: 1497 - RNA, 19 nt, synthetic construct
  misc_feature 1..19: note = siRNA Sense Sequence
  source 1..19: mol_type = other RNA
tggcttttgctctagaagt

SEQ ID NO: 1498 - RNA, 19 nt, synthetic construct
  misc_feature 1..19: note = siRNA Antisense Sequence
  source 1..19: mol_type = other RNA
acttctagagcaaaagcca

SEQ ID NO: 1499 - RNA, 19 nt, synthetic construct
  misc_feature 1..19: note = siRNA Sense Sequence
  source 1..19: mol_type = other RNA
ggcttttgctctagaagtc

SEQ ID NO: 1500 - RNA, 19 nt, synthetic construct
  misc_feature 1..19: note = siRNA Antisense Sequence
  source 1..19: mol_type = other RNA
gacttctagagcaaaagcc

SEQ ID NO: 1501 - RNA, 19 nt, synthetic construct
  misc_feature 1..19: note = siRNA Sense Sequence
  source 1..19: mol_type = other RNA
gcttttgctctagaagtca

SEQ ID NO: 1502 - RNA, 19 nt, synthetic construct
  misc_feature 1..19: note = siRNA Antisense Sequence
  source 1..19: mol_type = other RNA
tgacttctagagcaaaagc

SEQ ID NO: 1503 - RNA, 19 nt, synthetic construct
  misc_feature 1..19: note = siRNA Sense Sequence
  source 1..19: mol_type = other RNA
cttttgctctagaagtcaa

SEQ ID NO: 1504 - RNA, 19 nt, synthetic construct
  misc_feature 1..19: note = siRNA Antisense Sequence
  source 1..19: mol_type = other RNA
ttgacttctagagcaaaag

SEQ ID NO: 1505 - RNA, 19 nt, synthetic construct
  misc_feature 1..19: note = siRNA Sense Sequence
  source 1..19: mol_type = other RNA
ttttgctctagaagtcaac

SEQ ID NO: 1506 - RNA, 19 nt, synthetic construct
  misc_feature 1..19: note = siRNA Antisense Sequence
  source 1..19: mol_type = other RNA
gttgacttctagagcaaaa

SEQ ID NO: 1507 - RNA, 19 nt, synthetic construct
  misc_feature 1..19: note = siRNA Sense Sequence
  source 1..19: mol_type = other RNA
ttcatcttcatcctcacat

SEQ ID NO: 1508 - RNA, 19 nt, synthetic construct
  misc_feature 1..19: note = siRNA Antisense Sequence
  source 1..19: mol_type = other RNA
atgtgaggatgaagatgaa

SEQ ID NO: 1509 - RNA, 19 nt, synthetic construct
  misc_feature 1..19: note = siRNA Sense Sequence
  source 1..19: mol_type = other RNA
tcatcttcatcctcacatt

SEQ ID NO: 1510 - RNA, 19 nt, synthetic construct
  misc_feature 1..19: note = siRNA Antisense Sequence
  source 1..19: mol_type = other RNA
aatgtgaggatgaagatga

SEQ ID NO: 1511 - RNA, 19 nt, synthetic construct
  misc_feature 1..19: note = siRNA Sense Sequence
  source 1..19: mol_type = other RNA
catcttcatcctcacattg

SEQ ID NO: 1512 - RNA, 19 nt, synthetic construct
  misc_feature 1..19: note = siRNA Antisense Sequence
  source 1..19: mol_type = other RNA
caatgtgaggatgaagatg

SEQ ID NO: 1513 - RNA, 19 nt, synthetic construct
  misc_feature 1..19: note = siRNA Sense Sequence
  source 1..19: mol_type = other RNA
atcttcatcctcacattgg

SEQ ID NO: 1514 - RNA, 19 nt, synthetic construct
  misc_feature 1..19: note = siRNA Antisense Sequence
  source 1..19: mol_type = other RNA
ccaatgtgaggatgaagat

SEQ ID NO: 1515 - RNA, 19 nt, synthetic construct
  misc_feature 1..19: note = siRNA Sense Sequence
  source 1..19: mol_type = other RNA
tcttcatcctcacattggc

SEQ ID NO: 1516 - RNA, 19 nt, synthetic construct
  misc_feature 1..19: note = siRNA Antisense Sequence
  source 1..19: mol_type = other RNA
gccaatgtgaggatgaaga

SEQ ID NO: 1517 - RNA, 19 nt, synthetic construct
  misc_feature 1..19: note = siRNA Sense Sequence
  source 1..19: mol_type = other RNA
cttcatcctcacattggca

SEQ ID NO: 1518 - RNA, 19 nt, synthetic construct
  misc_feature 1..19: note = siRNA Antisense Sequence
  source 1..19: mol_type = other RNA
tgccaatgtgaggatgaag

SEQ ID NO: 1519 - RNA, 19 nt, synthetic construct
  misc_feature 1..19: note = siRNA Sense Sequence
  source 1..19: mol_type = other RNA
ttcatcctcacattggcat

SEQ ID NO: 1520 - RNA, 19 nt, synthetic construct
  misc_feature 1..19: note = siRNA Antisense Sequence
  source 1..19: mol_type = other RNA
atgccaatgtgaggatgaa

SEQ ID NO: 1521 - RNA, 19 nt, synthetic construct
  misc_feature 1..19: note = siRNA Sense Sequence
  source 1..19: mol_type = other RNA
tcatcctcacattggcatc

SEQ ID NO: 1522 - RNA, 19 nt, synthetic construct
  misc_feature 1..19: note = siRNA Antisense Sequence
  source 1..19: mol_type = other RNA
gatgccaatgtgaggatga

SEQ ID NO: 1523 - RNA, 19 nt, synthetic construct
  misc_feature 1..19: note = siRNA Sense Sequence
  source 1..19: mol_type = other RNA
catcctcacattggcatca

SEQ ID NO: 1524 - RNA, 19 nt, synthetic construct
  misc_feature 1..19: note = siRNA Antisense Sequence
  source 1..19: mol_type = other RNA
tgatgccaatgtgaggatg

SEQ ID NO: 1525 - RNA, 19 nt, synthetic construct
  misc_feature 1..19: note = siRNA Sense Sequence
  source 1..19: mol_type = other RNA
ccctaataaccatcacagt

SEQ ID NO: 1526 - RNA, 19 nt, synthetic construct
  misc_feature 1..19: note = siRNA Antisense Sequence
  source 1..19: mol_type = other RNA
actgtgatggttattaggg

SEQ ID NO: 1527 - RNA, 19 nt, synthetic construct
  misc_feature 1..19: note = siRNA Sense Sequence
  source 1..19: mol_type = other RNA
cctaataaccatcacagtg

SEQ ID NO: 1528 - RNA, 19 nt, synthetic construct
  misc_feature 1..19: note = siRNA Antisense Sequence
  source 1..19: mol_type = other RNA
cactgtgatggttattagg

SEQ ID NO: 1529 - RNA, 19 nt, synthetic construct
  misc_feature 1..19: note = siRNA Sense Sequence
  source 1..19: mol_type = other RNA
agcaagagcactacatgaa

SEQ ID NO: 1530 - RNA, 19 nt, synthetic construct
  misc_feature 1..19: note = siRNA Antisense Sequence
  source 1..19: mol_type = other RNA
ttcatgtagtgctcttgct

SEQ ID NO: 1531 - RNA, 19 nt, synthetic construct
  misc_feature 1..19: note = siRNA Sense Sequence
  source 1..19: mol_type = other RNA
gcaagagcactacatgaag

SEQ ID NO: 1532 - RNA, 19 nt, synthetic construct
  misc_feature 1..19: note = siRNA Antisense Sequence
  source 1..19: mol_type = other RNA
cttcatgtagtgctcttgc

SEQ ID NO: 1533 - RNA, 19 nt, synthetic construct
  misc_feature 1..19: note = siRNA Sense Sequence
  source 1..19: mol_type = other RNA
cactacatgaagggctctg

SEQ ID NO: 1534 - RNA, 19 nt, synthetic construct
  misc_feature 1..19: note = siRNA Antisense Sequence
  source 1..19: mol_type = other RNA
cagagcccttcatgtagtg

SEQ ID NO: 1535 - RNA, 19 nt, synthetic construct
  misc_feature 1..19: note = siRNA Sense Sequence
  source 1..19: mol_type = other RNA
actacatgaagggctctga

SEQ ID NO: 1536 - RNA, 19 nt, synthetic construct
  misc_feature 1..19: note = siRNA Antisense Sequence
  source 1..19: mol_type = other RNA
tcagagcccttcatgtagt

SEQ ID NO: 1537 - RNA, 19 nt, synthetic construct
  misc_feature 1..19: note = siRNA Sense Sequence
  source 1..19: mol_type = other RNA
ctacatgaagggctctgac

SEQ ID NO: 1538 - RNA, 19 nt, synthetic construct
  misc_feature 1..19: note = siRNA Antisense Sequence
  source 1..19: mol_type = other RNA
gtcagagcccttcatgtag

SEQ ID NO: 1539 - RNA, 19 nt, synthetic construct
  misc_feature 1..19: note = siRNA Sense Sequence
  source 1..19: mol_type = other RNA
tacatgaagggctctgacg

SEQ ID NO: 1540 - RNA, 19 nt, synthetic construct
  misc_feature 1..19: note = siRNA Antisense Sequence
  source 1..19: mol_type = other RNA
cgtcagagcccttcatgta

SEQ ID NO: 1541 - RNA, 19 nt, synthetic construct
  misc_feature 1..19: note = siRNA Sense Sequence
  source 1..19: mol_type = other RNA
acatgaagggctctgacgg

SEQ ID NO: 1542 - RNA, 19 nt, synthetic construct
  misc_feature 1..19: note = siRNA Antisense Sequence
  source 1..19: mol_type = other RNA
ccgtcagagcccttcatgt

SEQ ID NO: 1543 - RNA, 19 nt, synthetic construct
  misc_feature 1..19: note = siRNA Sense Sequence
  source 1..19: mol_type = other RNA
catgaagggctctgacggc

SEQ ID NO: 1544 - RNA, 19 nt, synthetic construct
  misc_feature 1..19: note = siRNA Antisense Sequence
  source 1..19: mol_type = other RNA
gccgtcagagcccttcatg

SEQ ID NO: 1545 - RNA, 19 nt, synthetic construct
  misc_feature 1..19: note = siRNA Sense Sequence
  source 1..19: mol_type = other RNA
atgaagggctctgacggcg

SEQ ID NO: 1546 - RNA, 19 nt, synthetic construct
  misc_feature 1..19: note = siRNA Antisense Sequence
  source 1..19: mol_type = other RNA
cgccgtcagagcccttcat

SEQ ID NO: 1547 - RNA, 19 nt, synthetic construct
  misc_feature 1..19: note = siRNA Sense Sequence
  source 1..19: mol_type = other RNA
ccggacactgggtacctgt

SEQ ID NO: 1548 - RNA, 19 nt, synthetic construct
  misc_feature 1..19: note = siRNA Antisense Sequence
  source 1..19: mol_type = other RNA
acaggtacccagtgtccgg

SEQ ID NO: 1549 - RNA, 19 nt, synthetic construct
  misc_feature 1..19: note = siRNA Sense Sequence
  source 1..19: mol_type = other RNA
cggacactgggtacctgtg

SEQ ID NO: 1550 - RNA, 19 nt, synthetic construct
  misc_feature 1..19: note = siRNA Antisense Sequence
  source 1..19: mol_type = other RNA
cacaggtacccagtgtccg

SEQ ID NO: 1551 - RNA, 19 nt, synthetic construct
  misc_feature 1..19: note = siRNA Sense Sequence
  source 1..19: mol_type = other RNA
ggacactgggtacctgtgg

SEQ ID NO: 1552 - RNA, 19 nt, synthetic construct
  misc_feature 1..19: note = siRNA Antisense Sequence
  source 1..19: mol_type = other RNA
ccacaggtacccagtgtcc

SEQ ID NO: 1553 - RNA, 19 nt, synthetic construct
  misc_feature 1..19: note = siRNA Sense Sequence
  source 1..19: mol_type = other RNA
gacactgggtacctgtggc

SEQ ID NO: 1554 - RNA, 19 nt, synthetic construct
  misc_feature 1..19: note = siRNA Antisense Sequence
  source 1..19: mol_type = other RNA
gccacaggtacccagtgtc

SEQ ID NO: 1555 - RNA, 19 nt, synthetic construct
  misc_feature 1..19: note = siRNA Sense Sequence
  source 1..19: mol_type = other RNA
acactgggtacctgtggca

SEQ ID NO: 1556 - RNA, 19 nt, synthetic construct
  misc_feature 1..19: note = siRNA Antisense Sequence
  source 1..19: mol_type = other RNA
tgccacaggtacccagtgt

SEQ ID NO: 1557 - RNA, 19 nt, synthetic construct
  misc_feature 1..19: note = siRNA Sense Sequence
  source 1..19: mol_type = other RNA
cactgggtacctgtggcat

SEQ ID NO: 1558 - RNA, 19 nt, synthetic construct
  misc_feature 1..19: note = siRNA Antisense Sequence
  source 1..19: mol_type = other RNA
atgccacaggtacccagtg

SEQ ID NO: 1559 - RNA, 19 nt, synthetic construct
  misc_feature 1..19: note = siRNA Sense Sequence
  source 1..19: mol_type = other RNA
actgggtacctgtggcatg

SEQ ID NO: 1560 - RNA, 19 nt, synthetic construct
  misc_feature 1..19: note = siRNA Antisense Sequence
  source 1..19: mol_type = other RNA
catgccacaggtacccagt

SEQ ID NO: 1561 - RNA, 19 nt, synthetic construct
  misc_feature 1..19: note = siRNA Sense Sequence
  source 1..19: mol_type = other RNA
ctgggtacctgtggcatgt

SEQ ID NO: 1562 - RNA, 19 nt, synthetic construct
  misc_feature 1..19: note = siRNA Antisense Sequence
  source 1..19: mol_type = other RNA
acatgccacaggtacccag

SEQ ID NO: 1563 - RNA, 19 nt, synthetic construct
  misc_feature 1..19: note = siRNA Sense Sequence
  source 1..19: mol_type = other RNA
tgggtacctgtggcatgtt

SEQ ID NO: 1564 - RNA, 19 nt, synthetic construct
  misc_feature 1..19: note = siRNA Antisense Sequence
  source 1..19: mol_type = other RNA
aacatgccacaggtaccca

SEQ ID NO: 1565 - RNA, 19 nt, synthetic construct
  misc_feature 1..19: note = siRNA Sense Sequence
  source 1..19: mol_type = other RNA
gggtacctgtggcatgttc

SEQ ID NO: 1566 - RNA, 19 nt, synthetic construct
  misc_feature 1..19: note = siRNA Antisense Sequence
  source 1..19: mol_type = other RNA
gaacatgccacaggtaccc

SEQ ID NO: 1567 - RNA, 19 nt, synthetic construct
  misc_feature 1..19: note = siRNA Sense Sequence
  source 1..19: mol_type = other RNA
ggtacctgtggcatgttcc

SEQ ID NO: 1568 - RNA, 19 nt, synthetic construct
  misc_feature 1..19: note = siRNA Antisense Sequence
  source 1..19: mol_type = other RNA
ggaacatgccacaggtacc

SEQ ID NO: 1569 - RNA, 19 nt, synthetic construct
  misc_feature 1..19: note = siRNA Sense Sequence
  source 1..19: mol_type = other RNA
gtacctgtggcatgttcca

SEQ ID NO: 1570 - RNA, 19 nt, synthetic construct
  misc_feature 1..19: note = siRNA Antisense Sequence
  source 1..19: mol_type = other RNA
tggaacatgccacaggtac

SEQ ID NO: 1571 - RNA, 19 nt, synthetic construct
  misc_feature 1..19: note = siRNA Sense Sequence
  source 1..19: mol_type = other RNA
tacctgtggcatgttccat

SEQ ID NO: 1572 - RNA, 19 nt, synthetic construct
  misc_feature 1..19: note = siRNA Antisense Sequence
  source 1..19: mol_type = other RNA
atggaacatgccacaggta

SEQ ID NO: 1573 - RNA, 19 nt, synthetic construct
  misc_feature 1..19: note = siRNA Sense Sequence
  source 1..19: mol_type = other RNA
acctgtggcatgttccatt

SEQ ID NO: 1574 - RNA, 19 nt, synthetic construct
  misc_feature 1..19: note = siRNA Antisense Sequence
  source 1..19: mol_type = other RNA
aatggaacatgccacaggt

SEQ ID NO: 1575 - RNA, 19 nt, synthetic construct
  misc_feature 1..19: note = siRNA Sense Sequence
  source 1..19: mol_type = other RNA
cctgtggcatgttccattg

SEQ ID NO: 1576 - RNA, 19 nt, synthetic construct
  misc_feature 1..19: note = siRNA Antisense Sequence
  source 1..19: mol_type = other RNA
caatggaacatgccacagg

SEQ ID NO: 1577 - RNA, 19 nt, synthetic construct
  misc_feature 1..19: note = siRNA Sense Sequence
  source 1..19: mol_type = other RNA
ctgtggcatgttccattga

SEQ ID NO: 1578 - RNA, 19 nt, synthetic construct
  misc_feature 1..19: note = siRNA Antisense Sequence
  source 1..19: mol_type = other RNA
tcaatggaacatgccacag

SEQ ID NO: 1579 - RNA, 19 nt, synthetic construct
  misc_feature 1..19: note = siRNA Sense Sequence
  source 1..19: mol_type = other RNA
tgtggcatgttccattgac

SEQ ID NO: 1580 - RNA, 19 nt, synthetic construct
  misc_feature 1..19: note = siRNA Antisense Sequence
  source 1..19: mol_type = other RNA
gtcaatggaacatgccaca

SEQ ID NO: 1581 - RNA, 19 nt, synthetic construct
  misc_feature 1..19: note = siRNA Sense Sequence
  source 1..19: mol_type = other RNA
gtggcatgttccattgaca

SEQ ID NO: 1582 - RNA, 19 nt, synthetic construct
  misc_feature 1..19: note = siRNA Antisense Sequence
  source 1..19: mol_type = other RNA
tgtcaatggaacatgccac

SEQ ID NO: 1583 - RNA, 19 nt, synthetic construct
  misc_feature 1..19: note = siRNA Sense Sequence
  source 1..19: mol_type = other RNA
tgttccattgacattcatc

SEQ ID NO: 1584 - RNA, 19 nt, synthetic construct
  misc_feature 1..19: note = siRNA Antisense Sequence
  source 1..19: mol_type = other RNA
gatgaatgtcaatggaaca

SEQ ID NO: 1585 - RNA, 19 nt, synthetic construct
  misc_feature 1..19: note = siRNA Sense Sequence
  source 1..19: mol_type = other RNA
tccattgacattcatcacc

SEQ ID NO: 1586 - RNA, 19 nt, synthetic construct
  misc_feature 1..19: note = siRNA Antisense Sequence
  source 1..19: mol_type = other RNA
ggtgatgaatgtcaatgga

SEQ ID NO: 1587 - RNA, 19 nt, synthetic construct
  misc_feature 1..19: note = siRNA Sense Sequence
  source 1..19: mol_type = other RNA
cattgacattcatcaccag

SEQ ID NO: 1588 - RNA, 19 nt, synthetic construct
  misc_feature 1..19: note = siRNA Antisense Sequence
  source 1..19: mol_type = other RNA
ctggtgatgaatgtcaatg

SEQ ID NO: 1589 - RNA, 19 nt, synthetic construct
  misc_feature 1..19: note = siRNA Sense Sequence
  source 1..19: mol_type = other RNA
acattcatcaccagcaaat

SEQ ID NO: 1590 - RNA, 19 nt, synthetic construct
  misc_feature 1..19: note = siRNA Antisense Sequence
  source 1..19: mol_type = other RNA
atttgctggtgatgaatgt

SEQ ID NO: 1591 - RNA, 19 nt, synthetic construct
  misc_feature 1..19: note = siRNA Sense Sequence
  source 1..19: mol_type = other RNA
ctcccagaagaggtggaat

SEQ ID NO: 1592 - RNA, 19 nt, synthetic construct
  misc_feature 1..19: note = siRNA Antisense Sequence
  source 1..19: mol_type = other RNA
attccacctcttctgggag

SEQ ID NO: 1593 - RNA, 19 nt, synthetic construct
  misc_feature 1..19: note = siRNA Sense Sequence
  source 1..19: mol_type = other RNA
tcccagaagaggtggaatg

SEQ ID NO: 1594 - RNA, 19 nt, synthetic construct
  misc_feature 1..19: note = siRNA Antisense Sequence
  source 1..19: mol_type = other RNA
cattccacctcttctggga

SEQ ID NO: 1595 - RNA, 19 nt, synthetic construct
  misc_feature 1..19: note = siRNA Sense Sequence
  source 1..19: mol_type = other RNA
cccagaagaggtggaatgg

SEQ ID NO: 1596 - RNA, 19 nt, synthetic construct
  misc_feature 1..19: note = siRNA Antisense Sequence
  source 1..19: mol_type = other RNA
ccattccacctcttctggg

SEQ ID NO: 1597 - RNA, 19 nt, synthetic construct
  misc_feature 1..19: note = siRNA Sense Sequence
  source 1..19: mol_type = other RNA
ccagaagaggtggaatgga

SEQ ID NO: 1598 - RNA, 19 nt, synthetic construct
  misc_feature 1..19: note = siRNA Antisense Sequence
  source 1..19: mol_type = other RNA
tccattccacctcttctgg

SEQ ID NO: 1599 - RNA, 19 nt, synthetic construct
  misc_feature 1..19: note = siRNA Sense Sequence
  source 1..19: mol_type = other RNA
cagaagaggtggaatggat

SEQ ID NO: 1600 - RNA, 19 nt, synthetic construct
  misc_feature 1..19: note = siRNA Antisense Sequence
  source 1..19: mol_type = other RNA
atccattccacctcttctg

SEQ ID NO: 1601 - RNA, 19 nt, synthetic construct
  misc_feature 1..19: note = siRNA Sense Sequence
  source 1..19: mol_type = other RNA
agaagaggtggaatggatc

SEQ ID NO: 1602 - RNA, 19 nt, synthetic construct
  misc_feature 1..19: note = siRNA Antisense Sequence
  source 1..19: mol_type = other RNA
gatccattccacctcttct

SEQ ID NO: 1603 - RNA, 19 nt, synthetic construct
  misc_feature 1..19: note = siRNA Sense Sequence
  source 1..19: mol_type = other RNA
gaagaggtggaatggatca

SEQ ID NO: 1604 - RNA, 19 nt, synthetic construct
  misc_feature 1..19: note = siRNA Antisense Sequence
  source 1..19: mol_type = other RNA
tgatccattccacctcttc

SEQ ID NO: 1605 - RNA, 19 nt, synthetic construct
  misc_feature 1..19: note = siRNA Sense Sequence
  source 1..19: mol_type = other RNA
gaggtggaatggatcaaat

SEQ ID NO: 1606 - RNA, 19 nt, synthetic construct
  misc_feature 1..19: note = siRNA Antisense Sequence
  source 1..19: mol_type = other RNA
atttgatccattccacctc

SEQ ID NO: 1607 - RNA, 19 nt, synthetic construct
  misc_feature 1..19: note = siRNA Sense Sequence
  source 1..19: mol_type = other RNA
aggtggaatggatcaaatt

SEQ ID NO: 1608 - RNA, 19 nt, synthetic construct
  misc_feature 1..19: note = siRNA Antisense Sequence
  source 1..19: mol_type = other RNA
aatttgatccattccacct

SEQ ID NO: 1609 - RNA, 19 nt, synthetic construct
  misc_feature 1..19: note = siRNA Sense Sequence
  source 1..19: mol_type = other RNA
ggtggaatggatcaaattt

SEQ ID NO: 1610 - RNA, 19 nt, synthetic construct
  misc_feature 1..19: note = siRNA Antisense Sequence
  source 1..19: mol_type = other RNA
aaatttgatccattccacc

SEQ ID NO: 1611 - RNA, 19 nt, synthetic construct
  misc_feature 1..19: note = siRNA Sense Sequence
  source 1..19: mol_type = other RNA
gtggaatggatcaaattta

SEQ ID NO: 1612 - RNA, 19 nt, synthetic construct
  misc_feature 1..19: note = siRNA Antisense Sequence
  source 1..19: mol_type = other RNA
taaatttgatccattccac

SEQ ID NO: 1613 - RNA, 19 nt, synthetic construct
  misc_feature 1..19: note = siRNA Sense Sequence
  source 1..19: mol_type = other RNA
gatcaaatttaatgtgggc

SEQ ID NO: 1614 - RNA, 19 nt, synthetic construct
  misc_feature 1..19: note = siRNA Antisense Sequence
  source 1..19: mol_type = other RNA
gcccacattaaatttgatc

SEQ ID NO: 1615 - RNA, 19 nt, synthetic construct
  misc_feature 1..19: note = siRNA Sense Sequence
  source 1..19: mol_type = other RNA
atcaaatttaatgtgggca

SEQ ID NO: 1616 - RNA, 19 nt, synthetic construct
  misc_feature 1..19: note = siRNA Antisense Sequence
  source 1..19: mol_type = other RNA
tgcccacattaaatttgat

SEQ ID NO: 1617 - RNA, 19 nt, synthetic construct
  misc_feature 1..19: note = siRNA Sense Sequence
  source 1..19: mol_type = other RNA
tcaaatttaatgtgggcat

SEQ ID NO: 1618 - RNA, 19 nt, synthetic construct
  misc_feature 1..19: note = siRNA Antisense Sequence
  source 1..19: mol_type = other RNA
atgcccacattaaatttga

SEQ ID NO: 1619 - RNA, 19 nt, synthetic construct
  misc_feature 1..19: note = siRNA Sense Sequence
  source 1..19: mol_type = other RNA
caaatttaatgtgggcatg

SEQ ID NO: 1620 - RNA, 19 nt, synthetic construct
  misc_feature 1..19: note = siRNA Antisense Sequence
  source 1..19: mol_type = other RNA
catgcccacattaaatttg

SEQ ID NO: 1621 - RNA, 19 nt, synthetic construct
  misc_feature 1..19: note = siRNA Sense Sequence
  source 1..19: mol_type = other RNA
aaatttaatgtgggcatga

SEQ ID NO: 1622 - RNA, 19 nt, synthetic construct
  misc_feature 1..19: note = siRNA Antisense Sequence
  source 1..19: mol_type = other RNA
tcatgcccacattaaattt

SEQ ID NO: 1623 - RNA, 19 nt, synthetic construct
  misc_feature 1..19: note = siRNA Sense Sequence
  source 1..19: mol_type = other RNA
aatttaatgtgggcatgaa

SEQ ID NO: 1624 - RNA, 19 nt, synthetic construct
  misc_feature 1..19: note = siRNA Antisense Sequence
  source 1..19: mol_type = other RNA
ttcatgcccacattaaatt

SEQ ID NO: 1625 - RNA, 19 nt, synthetic construct
  misc_feature 1..19: note = siRNA Sense Sequence
  source 1..19: mol_type = other RNA
taatgtgggcatgaatggc

SEQ ID NO: 1626 - RNA, 19 nt, synthetic construct
  misc_feature 1..19: note = siRNA Antisense Sequence
  source 1..19: mol_type = other RNA
gccattcatgcccacatta

SEQ ID NO: 1627 - RNA, 19 nt, synthetic construct
  misc_feature 1..19: note = siRNA Sense Sequence
  source 1..19: mol_type = other RNA
aatgtgggcatgaatggct

SEQ ID NO: 1628 - RNA, 19 nt, synthetic construct
  misc_feature 1..19: note = siRNA Antisense Sequence
  source 1..19: mol_type = other RNA
agccattcatgcccacatt

SEQ ID NO: 1629 - RNA, 19 nt, synthetic construct
  misc_feature 1..19: note = siRNA Sense Sequence
  source 1..19: mol_type = other RNA
atgtgggcatgaatggcta

SEQ ID NO: 1630 - RNA, 19 nt, synthetic construct
  misc_feature 1..19: note = siRNA Antisense Sequence
  source 1..19: mol_type = other RNA
tagccattcatgcccacat

SEQ ID NO: 1631 - RNA, 19 nt, synthetic construct
  misc_feature 1..19: note = siRNA Sense Sequence
  source 1..19: mol_type = other RNA
tgtgggcatgaatggctat

SEQ ID NO: 1632 - RNA, 19 nt, synthetic construct
  misc_feature 1..19: note = siRNA Antisense Sequence
  source 1..19: mol_type = other RNA
atagccattcatgcccaca

SEQ ID NO: 1633 - RNA, 19 nt, synthetic construct
  misc_feature 1..19: note = siRNA Sense Sequence
  source 1..19: mol_type = other RNA
gtgggcatgaatggctatt

SEQ ID NO: 1634 - RNA, 19 nt, synthetic construct
  misc_feature 1..19: note = siRNA Antisense Sequence
  source 1..19: mol_type = other RNA
aatagccattcatgcccac

SEQ ID NO: 1635 - RNA, 19 nt, synthetic construct
  misc_feature 1..19: note = siRNA Sense Sequence
  source 1..19: mol_type = other RNA
tgggcatgaatggctatta

SEQ ID NO: 1636 - RNA, 19 nt, synthetic construct
  misc_feature 1..19: note = siRNA Antisense Sequence
  source 1..19: mol_type = other RNA
taatagccattcatgccca

SEQ ID NO: 1637 - RNA, 19 nt, synthetic construct
  misc_feature 1..19: note = siRNA Sense Sequence
  source 1..19: mol_type = other RNA
gggcatgaatggctattac

SEQ ID NO: 1638 - RNA, 19 nt, synthetic construct
  misc_feature 1..19: note = siRNA Antisense Sequence
  source 1..19: mol_type = other RNA
gtaatagccattcatgccc

SEQ ID NO: 1639 - RNA, 19 nt, synthetic construct
  misc_feature 1..19: note = siRNA Sense Sequence
  source 1..19: mol_type = other RNA
ggcatgaatggctattaca

SEQ ID NO: 1640 - RNA, 19 nt, synthetic construct
  misc_feature 1..19: note = siRNA Antisense Sequence
  source 1..19: mol_type = other RNA
tgtaatagccattcatgcc

SEQ ID NO: 1641 - RNA, 19 nt, synthetic construct
  misc_feature 1..19: note = siRNA Sense Sequence
  source 1..19: mol_type = other RNA
atggctattacattgtgca

SEQ ID NO: 1642 - RNA, 19 nt, synthetic construct
  misc_feature 1..19: note = siRNA Antisense Sequence
  source 1..19: mol_type = other RNA
tgcacaatgtaatagccat

SEQ ID NO: 1643 - RNA, 19 nt, synthetic construct
  misc_feature 1..19: note = siRNA Sense Sequence
  source 1..19: mol_type = other RNA
attacattgtgcattacga

SEQ ID NO: 1644 - RNA, 19 nt, synthetic construct
  misc_feature 1..19: note = siRNA Antisense Sequence
  source 1..19: mol_type = other RNA
tcgtaatgcacaatgtaat

SEQ ID NO: 1645 - RNA, 19 nt, synthetic construct
  misc_feature 1..19: note = siRNA Sense Sequence
  source 1..19: mol_type = other RNA
ttacattgtgcattacgag

SEQ ID NO: 1646 - RNA, 19 nt, synthetic construct
  misc_feature 1..19: note = siRNA Antisense Sequence
  source 1..19: mol_type = other RNA
ctcgtaatgcacaatgtaa

SEQ ID NO: 1647 - RNA, 19 nt, synthetic construct
  misc_feature 1..19: note = siRNA Sense Sequence
  source 1..19: mol_type = other RNA
tacattgtgcattacgagg

SEQ ID NO: 1648 - RNA, 19 nt, synthetic construct
  misc_feature 1..19: note = siRNA Antisense Sequence
  source 1..19: mol_type = other RNA
cctcgtaatgcacaatgta

SEQ ID NO: 1649 - RNA, 19 nt, synthetic construct
  misc_feature 1..19: note = siRNA Sense Sequence
  source 1..19: mol_type = other RNA
acattgtgcattacgagga

SEQ ID NO: 1650 - RNA, 19 nt, synthetic construct
  misc_feature 1..19: note = siRNA Antisense Sequence
  source 1..19: mol_type = other RNA
tcctcgtaatgcacaatgt

SEQ ID NO: 1651 - RNA, 19 nt, synthetic construct
  misc_feature 1..19: note = siRNA Sense Sequence
  source 1..19: mol_type = other RNA
cattgtgcattacgaggat

SEQ ID NO: 1652 - RNA, 19 nt, synthetic construct
  misc_feature 1..19: note = siRNA Antisense Sequence
  source 1..19: mol_type = other RNA
atcctcgtaatgcacaatg

SEQ ID NO: 1653 - RNA, 19 nt, synthetic construct
  misc_feature 1..19: note = siRNA Sense Sequence
  source 1..19: mol_type = other RNA
attgtgcattacgaggatg

SEQ ID NO: 1654 - RNA, 19 nt, synthetic construct
  misc_feature 1..19: note = siRNA Antisense Sequence
  source 1..19: mol_type = other RNA
catcctcgtaatgcacaat

SEQ ID NO: 1655 - RNA, 19 nt, synthetic construct
  misc_feature 1..19: note = siRNA Sense Sequence
  source 1..19: mol_type = other RNA
ttgtgcattacgaggatga

SEQ ID NO: 1656 - RNA, 19 nt, synthetic construct
  misc_feature 1..19: note = siRNA Antisense Sequence
  source 1..19: mol_type = other RNA
tcatcctcgtaatgcacaa

SEQ ID NO: 1657 - RNA, 19 nt, synthetic construct
  misc_feature 1..19: note = siRNA Sense Sequence
  source 1..19: mol_type = other RNA
tgtgcattacgaggatgat

SEQ ID NO: 1658 - RNA, 19 nt, synthetic construct
  misc_feature 1..19: note = siRNA Antisense Sequence
  source 1..19: mol_type = other RNA
atcatcctcgtaatgcaca

SEQ ID NO: 1659 - RNA, 19 nt, synthetic construct
  misc_feature 1..19: note = siRNA Sense Sequence
  source 1..19: mol_type = other RNA
gtgcattacgaggatgatg

SEQ ID NO: 1660 - RNA, 19 nt, synthetic construct
  misc_feature 1..19: note = siRNA Antisense Sequence
  source 1..19: mol_type = other RNA
catcatcctcgtaatgcac

SEQ ID NO: 1661 - RNA, 19 nt, synthetic construct
  misc_feature 1..19: note = siRNA Sense Sequence
  source 1..19: mol_type = other RNA
tgcattacgaggatgatgg

SEQ ID NO: 1662 - RNA, 19 nt, synthetic construct
  misc_feature 1..19: note = siRNA Antisense Sequence
  source 1..19: mol_type = other RNA
ccatcatcctcgtaatgca

SEQ ID NO: 1663 - RNA, 19 nt, synthetic construct
  misc_feature 1..19: note = siRNA Sense Sequence
  source 1..19: mol_type = other RNA
gcattacgaggatgatgga

SEQ ID NO: 1664 - RNA, 19 nt, synthetic construct
  misc_feature 1..19: note = siRNA Antisense Sequence
  source 1..19: mol_type = other RNA
tccatcatcctcgtaatgc

SEQ ID NO: 1665 - RNA, 19 nt, synthetic construct
  misc_feature 1..19: note = siRNA Sense Sequence
  source 1..19: mol_type = other RNA
cattacgaggatgatggat

SEQ ID NO: 1666 - RNA, 19 nt, synthetic construct
  misc_feature 1..19: note = siRNA Antisense Sequence
  source 1..19: mol_type = other RNA
atccatcatcctcgtaatg

SEQ ID NO: 1667 - RNA, 19 nt, synthetic construct
  misc_feature 1..19: note = siRNA Sense Sequence
  source 1..19: mol_type = other RNA
attacgaggatgatggatg

SEQ ID NO: 1668 - RNA, 19 nt, synthetic construct
  misc_feature 1..19: note = siRNA Antisense Sequence
  source 1..19: mol_type = other RNA
catccatcatcctcgtaat

SEQ ID NO: 1669 - RNA, 19 nt, synthetic construct
  misc_feature 1..19: note = siRNA Sense Sequence
  source 1..19: mol_type = other RNA
ttacgaggatgatggatgg

SEQ ID NO: 1670 - RNA, 19 nt, synthetic construct
  misc_feature 1..19: note = siRNA Antisense Sequence
  source 1..19: mol_type = other RNA
ccatccatcatcctcgtaa

SEQ ID NO: 1671 - RNA, 19 nt, synthetic construct
  misc_feature 1..19: note = siRNA Sense Sequence
  source 1..19: mol_type = other RNA
tacgaggatgatggatggg

SEQ ID NO: 1672 - RNA, 19 nt, synthetic construct
  misc_feature 1..19: note = siRNA Antisense Sequence
  source 1..19: mol_type = other RNA
cccatccatcatcctcgta

SEQ ID NO: 1673 - RNA, 19 nt, synthetic construct
  misc_feature 1..19: note = siRNA Sense Sequence
  source 1..19: mol_type = other RNA
acgaggatgatggatggga

SEQ ID NO: 1674 - RNA, 19 nt, synthetic construct
  misc_feature 1..19: note = siRNA Antisense Sequence
  source 1..19: mol_type = other RNA
tcccatccatcatcctcgt

SEQ ID NO: 1675 - RNA, 19 nt, synthetic construct
  misc_feature 1..19: note = siRNA Sense Sequence
  source 1..19: mol_type = other RNA
cgaggatgatggatgggac

SEQ ID NO: 1676 - RNA, 19 nt, synthetic construct
  misc_feature 1..19: note = siRNA Antisense Sequence
  source 1..19: mol_type = other RNA
gtcccatccatcatcctcg

SEQ ID NO: 1677 - RNA, 19 nt, synthetic construct
  misc_feature 1..19: note = siRNA Sense Sequence
  source 1..19: mol_type = other RNA
gaggatgatggatgggact

SEQ ID NO: 1678 - RNA, 19 nt, synthetic construct
  misc_feature 1..19: note = siRNA Antisense Sequence
  source 1..19: mol_type = other RNA
agtcccatccatcatcctc

SEQ ID NO: 1679 - RNA, 19 nt, synthetic construct
  misc_feature 1..19: note = siRNA Sense Sequence
  source 1..19: mol_type = other RNA
aggatgatggatgggactc

SEQ ID NO: 1680 - RNA, 19 nt, synthetic construct
  misc_feature 1..19: note = siRNA Antisense Sequence
  source 1..19: mol_type = other RNA
gagtcccatccatcatcct

SEQ ID NO: 1681 - RNA, 19 nt, synthetic construct
  misc_feature 1..19: note = siRNA Sense Sequence
  source 1..19: mol_type = other RNA
ggatgatggatgggactct

SEQ ID NO: 1682 - RNA, 19 nt, synthetic construct
  misc_feature 1..19: note = siRNA Antisense Sequence
  source 1..19: mol_type = other RNA
agagtcccatccatcatcc

SEQ ID NO: 1683 - RNA, 19 nt, synthetic construct
  misc_feature 1..19: note = siRNA Sense Sequence
  source 1..19: mol_type = other RNA
gatgatggatgggactctt

SEQ ID NO: 1684 - RNA, 19 nt, synthetic construct
  misc_feature 1..19: note = siRNA Antisense Sequence
  source 1..19: mol_type = other RNA
aagagtcccatccatcatc

SEQ ID NO: 1685 - RNA, 19 nt, synthetic construct
  misc_feature 1..19: note = siRNA Sense Sequence
  source 1..19: mol_type = other RNA
atgatggatgggactcttt

SEQ ID NO: 1686 - RNA, 19 nt, synthetic construct
  misc_feature 1..19: note = siRNA Antisense Sequence
  source 1..19: mol_type = other RNA
aaagagtcccatccatcat

SEQ ID NO: 1687 - RNA, 19 nt, synthetic construct
  misc_feature 1..19: note = siRNA Sense Sequence
  source 1..19: mol_type = other RNA
tgatggatgggactctttg

SEQ ID NO: 1688 - RNA, 19 nt, synthetic construct
  misc_feature 1..19: note = siRNA Antisense Sequence
  source 1..19: mol_type = other RNA
caaagagtcccatccatca

SEQ ID NO: 1689 - RNA, 19 nt, synthetic construct
  misc_feature 1..19: note = siRNA Sense Sequence
  source 1..19: mol_type = other RNA
gatggatgggactctttga

SEQ ID NO: 1690 - RNA, 19 nt, synthetic construct
  misc_feature 1..19: note = siRNA Antisense Sequence
  source 1..19: mol_type = other RNA
tcaaagagtcccatccatc

SEQ ID NO: 1691 - RNA, 19 nt, synthetic construct
  misc_feature 1..19: note = siRNA Sense Sequence
  source 1..19: mol_type = other RNA
atggatgggactctttgac

SEQ ID NO: 1692 - RNA, 19 nt, synthetic construct
  misc_feature 1..19: note = siRNA Antisense Sequence
  source 1..19: mol_type = other RNA
gtcaaagagtcccatccat

SEQ ID NO: 1693 - RNA, 19 nt, synthetic construct
  misc_feature 1..19: note = siRNA Sense Sequence
  source 1..19: mol_type = other RNA
tggatgggactctttgact

SEQ ID NO: 1694 - RNA, 19 nt, synthetic construct
  misc_feature 1..19: note = siRNA Antisense Sequence
  source 1..19: mol_type = other RNA
agtcaaagagtcccatcca

SEQ ID NO: 1695 - RNA, 19 nt, synthetic construct
  misc_feature 1..19: note = siRNA Sense Sequence
  source 1..19: mol_type = other RNA
ggatgggactctttgactg

SEQ ID NO: 1696 - RNA, 19 nt, synthetic construct
  misc_feature 1..19: note = siRNA Antisense Sequence
  source 1..19: mol_type = other RNA
cagtcaaagagtcccatcc

SEQ ID NO: 1697 - RNA, 19 nt, synthetic construct
  misc_feature 1..19: note = siRNA Sense Sequence
  source 1..19: mol_type = other RNA
gatgggactctttgactgg

SEQ ID NO: 1698 - RNA, 19 nt, synthetic construct
  misc_feature 1..19: note = siRNA Antisense Sequence
  source 1..19: mol_type = other RNA
ccagtcaaagagtcccatc

SEQ ID NO: 1699 - RNA, 19 nt, synthetic construct
  misc_feature 1..19: note = siRNA Sense Sequence
  source 1..19: mol_type = other RNA
atgggactctttgactggc

SEQ ID NO: 1700 - RNA, 19 nt, synthetic construct
  misc_feature 1..19: note = siRNA Antisense Sequence
  source 1..19: mol_type = other RNA
gccagtcaaagagtcccat

SEQ ID NO: 1701 - RNA, 19 nt, synthetic construct
  misc_feature 1..19: note = siRNA Sense Sequence
  source 1..19: mol_type = other RNA
tgggactctttgactggcc

SEQ ID NO: 1702 - RNA, 19 nt, synthetic construct
  misc_feature 1..19: note = siRNA Antisense Sequence
  source 1..19: mol_type = other RNA
ggccagtcaaagagtccca

SEQ ID NO: 1703 - RNA, 19 nt, synthetic construct
  misc_feature 1..19: note = siRNA Sense Sequence
  source 1..19: mol_type = other RNA
gggactctttgactggcct

SEQ ID NO: 1704 - RNA, 19 nt, synthetic construct
  misc_feature 1..19: note = siRNA Antisense Sequence
  source 1..19: mol_type = other RNA
aggccagtcaaagagtccc

SEQ ID NO: 1705 - RNA, 19 nt, synthetic construct
  misc_feature 1..19: note = siRNA Sense Sequence
  source 1..19: mol_type = other RNA
ggactctttgactggcctt

SEQ ID NO: 1706 - RNA, 19 nt, synthetic construct
  misc_feature 1..19: note = siRNA Antisense Sequence
  source 1..19: mol_type = other RNA
aaggccagtcaaagagtcc

SEQ ID NO: 1707 - RNA, 19 nt, synthetic construct
  misc_feature 1..19: note = siRNA Sense Sequence
  source 1..19: mol_type = other RNA
gactctttgactggccttt

SEQ ID NO: 1708 - RNA, 19 nt, synthetic construct
  misc_feature 1..19: note = siRNA Antisense Sequence
  source 1..19: mol_type = other RNA
aaaggccagtcaaagagtc

SEQ ID NO: 1709 - RNA, 19 nt, synthetic construct
  misc_feature 1..19: note = siRNA Sense Sequence
  source 1..19: mol_type = other RNA
actctttgactggcctttt

SEQ ID NO: 1710 - RNA, 19 nt, synthetic construct
  misc_feature 1..19: note = siRNA Antisense Sequence
  source 1..19: mol_type = other RNA
aaaaggccagtcaaagagt

SEQ ID NO: 1711 - RNA, 19 nt, synthetic construct
  misc_feature 1..19: note = siRNA Sense Sequence
  source 1..19: mol_type = other RNA
ctctttgactggcctttta

SEQ ID NO: 1712 - RNA, 19 nt, synthetic construct
  misc_feature 1..19: note = siRNA Antisense Sequence
  source 1..19: mol_type = other RNA
taaaaggccagtcaaagag

SEQ ID NO: 1713 - RNA, 19 nt, synthetic construct
  misc_feature 1..19: note = siRNA Sense Sequence
  source 1..19: mol_type = other RNA
tctttgactggccttttaa

SEQ ID NO: 1714 - RNA, 19 nt, synthetic construct
  misc_feature 1..19: note = siRNA Antisense Sequence
  source 1..19: mol_type = other RNA
ttaaaaggccagtcaaaga

SEQ ID NO: 1715 - RNA, 19 nt, synthetic construct
  misc_feature 1..19: note = siRNA Sense Sequence
  source 1..19: mol_type = other RNA
ctttgactggccttttaaa

SEQ ID NO: 1716 - RNA, 19 nt, synthetic construct
  misc_feature 1..19: note = siRNA Antisense Sequence
  source 1..19: mol_type = other RNA
tttaaaaggccagtcaaag

SEQ ID NO: 1717 - RNA, 19 nt, synthetic construct
  misc_feature 1..19: note = siRNA Sense Sequence
  source 1..19: mol_type = other RNA
tttgactggccttttaaaa

SEQ ID NO: 1718 - RNA, 19 nt, synthetic construct
  misc_feature 1..19: note = siRNA Antisense Sequence
  source 1..19: mol_type = other RNA
ttttaaaaggccagtcaaa

SEQ ID NO: 1719 - RNA, 19 nt, synthetic construct
  misc_feature 1..19: note = siRNA Sense Sequence
  source 1..19: mol_type = other RNA
ttgactggccttttaaaag

SEQ ID NO: 1720 - RNA, 19 nt, synthetic construct
  misc_feature 1..19: note = siRNA Antisense Sequence
  source 1..19: mol_type = other RNA
cttttaaaaggccagtcaa

SEQ ID NO: 1721 - RNA, 19 nt, synthetic construct
  misc_feature 1..19: note = siRNA Sense Sequence
  source 1..19: mol_type = other RNA
cacagcagtcagcagtaat

SEQ ID NO: 1722 - RNA, 19 nt, synthetic construct
  misc_feature 1..19: note = siRNA Antisense Sequence
  source 1..19: mol_type = other RNA
attactgctgactgctgtg

SEQ ID NO: 1723 - RNA, 19 nt, synthetic construct
  misc_feature 1..19: note = siRNA Sense Sequence
  source 1..19: mol_type = other RNA
acagcagtcagcagtaatg

SEQ ID NO: 1724 - RNA, 19 nt, synthetic construct
  misc_feature 1..19: note = siRNA Antisense Sequence
  source 1..19: mol_type = other RNA
cattactgctgactgctgt

SEQ ID NO: 1725 - RNA, 19 nt, synthetic construct
  misc_feature 1..19: note = siRNA Sense Sequence
  source 1..19: mol_type = other RNA
cagcagtcagcagtaatga

SEQ ID NO: 1726 - RNA, 19 nt, synthetic construct
  misc_feature 1..19: note = siRNA Antisense Sequence
  source 1..19: mol_type = other RNA
tcattactgctgactgctg

SEQ ID NO: 1727 - RNA, 19 nt, synthetic construct
  misc_feature 1..19: note = siRNA Sense Sequence
  source 1..19: mol_type = other RNA
agcagtcagcagtaatgat

SEQ ID NO: 1728 - RNA, 19 nt, synthetic construct
  misc_feature 1..19: note = siRNA Antisense Sequence
  source 1..19: mol_type = other RNA
atcattactgctgactgct

SEQ ID NO: 1729 - RNA, 19 nt, synthetic construct
  misc_feature 1..19: note = siRNA Sense Sequence
  source 1..19: mol_type = other RNA
gcagtcagcagtaatgatc

SEQ ID NO: 1730 - RNA, 19 nt, synthetic construct
  misc_feature 1..19: note = siRNA Antisense Sequence
  source 1..19: mol_type = other RNA
gatcattactgctgactgc

SEQ ID NO: 1731 - RNA, 19 nt, synthetic construct
  misc_feature 1..19: note = siRNA Sense Sequence
  source 1..19: mol_type = other RNA
cagtcagcagtaatgatcg

SEQ ID NO: 1732 - RNA, 19 nt, synthetic construct
  misc_feature 1..19: note = siRNA Antisense Sequence
  source 1..19: mol_type = other RNA
cgatcattactgctgactg

SEQ ID NO: 1733 - RNA, 19 nt, synthetic construct
  misc_feature 1..19: note = siRNA Sense Sequence
  source 1..19: mol_type = other RNA
agtcagcagtaatgatcgg

SEQ ID NO: 1734 - RNA, 19 nt, synthetic construct
  misc_feature 1..19: note = siRNA Antisense Sequence
  source 1..19: mol_type = other RNA
ccgatcattactgctgact

SEQ ID NO: 1735 - RNA, 19 nt, synthetic construct
  misc_feature 1..19: note = siRNA Sense Sequence
  source 1..19: mol_type = other RNA
gtcagcagtaatgatcggg

SEQ ID NO: 1736 - RNA, 19 nt, synthetic construct
  misc_feature 1..19: note = siRNA Antisense Sequence
  source 1..19: mol_type = other RNA
cccgatcattactgctgac

SEQ ID NO: 1737 - RNA, 19 nt, synthetic construct
  misc_feature 1..19: note = siRNA Sense Sequence
  source 1..19: mol_type = other RNA
tcagcagtaatgatcgggc

SEQ ID NO: 1738 - RNA, 19 nt, synthetic construct
  misc_feature 1..19: note = siRNA Antisense Sequence
  source 1..19: mol_type = other RNA
gcccgatcattactgctga

SEQ ID NO: 1739 - RNA, 19 nt, synthetic construct
  misc_feature 1..19: note = siRNA Sense Sequence
  source 1..19: mol_type = other RNA
agcattgggaagctgtcca

SEQ ID NO: 1740 - RNA, 19 nt, synthetic construct
  misc_feature 1..19: note = siRNA Antisense Sequence
  source 1..19: mol_type = other RNA
tggacagcttcccaatgct

SEQ ID NO: 1741 - RNA, 19 nt, synthetic construct
  misc_feature 1..19: note = siRNA Sense Sequence
  source 1..19: mol_type = other RNA
gcattgggaagctgtccat

SEQ ID NO: 1742 - RNA, 19 nt, synthetic construct
  misc_feature 1..19: note = siRNA Antisense Sequence
  source 1..19: mol_type = other RNA
atggacagcttcccaatgc

SEQ ID NO: 1743 - RNA, 19 nt, synthetic construct
  misc_feature 1..19: note = siRNA Sense Sequence
  source 1..19: mol_type = other RNA
cattgggaagctgtccatt

SEQ ID NO: 1744 - RNA, 19 nt, synthetic construct
  misc_feature 1..19: note = siRNA Antisense Sequence
  source 1..19: mol_type = other RNA
aatggacagcttcccaatg

SEQ ID NO: 1745 - RNA, 19 nt, synthetic construct
  misc_feature 1..19: note = siRNA Sense Sequence
  source 1..19: mol_type = other RNA
attgggaagctgtccattg

SEQ ID NO: 1746 - RNA, 19 nt, synthetic construct
  misc_feature 1..19: note = siRNA Antisense Sequence
  source 1..19: mol_type = other RNA
caatggacagcttcccaat

SEQ ID NO: 1747 - RNA, 19 nt, synthetic construct
  misc_feature 1..19: note = siRNA Sense Sequence
  source 1..19: mol_type = other RNA
ttgggaagctgtccattga

SEQ ID NO: 1748 - RNA, 19 nt, synthetic construct
  misc_feature 1..19: note = siRNA Antisense Sequence
  source 1..19: mol_type = other RNA
tcaatggacagcttcccaa

SEQ ID NO: 1749 - RNA, 19 nt, synthetic construct
  misc_feature 1..19: note = siRNA Sense Sequence
  source 1..19: mol_type = other RNA
tgggaagctgtccattgaa

SEQ ID NO: 1750 - RNA, 19 nt, synthetic construct
  misc_feature 1..19: note = siRNA Antisense Sequence
  source 1..19: mol_type = other RNA
ttcaatggacagcttccca

SEQ ID NO: 1751 - RNA, 19 nt, synthetic construct
  misc_feature 1..19: note = siRNA Sense Sequence
  source 1..19: mol_type = other RNA
aaaaggccttggatttatc

SEQ ID NO: 1752 - RNA, 19 nt, synthetic construct
  misc_feature 1..19: note = siRNA Antisense Sequence
  source 1..19: mol_type = other RNA
gataaatccaaggcctttt

SEQ ID NO: 1753 - RNA, 19 nt, synthetic construct
  misc_feature 1..19: note = siRNA Sense Sequence
  source 1..19: mol_type = other RNA
aaaggccttggatttatcc

SEQ ID NO: 1754 - RNA, 19 nt, synthetic construct
  misc_feature 1..19: note = siRNA Antisense Sequence
  source 1..19: mol_type = other RNA
ggataaatccaaggccttt

SEQ ID NO: 1755 - RNA, 19 nt, synthetic construct
  misc_feature 1..19: note = siRNA Sense Sequence
  source 1..19: mol_type = other RNA
aaggccttggatttatccc

SEQ ID NO: 1756 - RNA, 19 nt, synthetic construct
  misc_feature 1..19: note = siRNA Antisense Sequence
  source 1..19: mol_type = other RNA
gggataaatccaaggcctt

SEQ ID NO: 1757 - RNA, 19 nt, synthetic construct
  misc_feature 1..19: note = siRNA Sense Sequence
  source 1..19: mol_type = other RNA
ccttggatttatccctgta

SEQ ID NO: 1758 - RNA, 19 nt, synthetic construct
  misc_feature 1..19: note = siRNA Antisense Sequence
  source 1..19: mol_type = other RNA
tacagggataaatccaagg

SEQ ID NO: 1759 - RNA, 19 nt, synthetic construct
  misc_feature 1..19: note = siRNA Sense Sequence
  source 1..19: mol_type = other RNA
cttggatttatccctgtac

SEQ ID NO: 1760 - RNA, 19 nt, synthetic construct
  misc_feature 1..19: note = siRNA Antisense Sequence
  source 1..19: mol_type = other RNA
gtacagggataaatccaag

SEQ ID NO: 1761 - RNA, 19 nt, synthetic construct
  misc_feature 1..19: note = siRNA Sense Sequence
  source 1..19: mol_type = other RNA
ttggatttatccctgtact

SEQ ID NO: 1762 - RNA, 19 nt, synthetic construct
  misc_feature 1..19: note = siRNA Antisense Sequence
  source 1..19: mol_type = other RNA
agtacagggataaatccaa

SEQ ID NO: 1763 - RNA, 19 nt, synthetic construct
  misc_feature 1..19: note = siRNA Sense Sequence
  source 1..19: mol_type = other RNA
tggatttatccctgtactt

SEQ ID NO: 1764 - RNA, 19 nt, synthetic construct
  misc_feature 1..19: note = siRNA Antisense Sequence
  source 1..19: mol_type = other RNA
aagtacagggataaatcca

SEQ ID NO: 1765 - RNA, 19 nt, synthetic construct
  misc_feature 1..19: note = siRNA Sense Sequence
  source 1..19: mol_type = other RNA
ggatttatccctgtacttg

SEQ ID NO: 1766 - RNA, 19 nt, synthetic construct
  misc_feature 1..19: note = siRNA Antisense Sequence
  source 1..19: mol_type = other RNA
caagtacagggataaatcc

SEQ ID NO: 1767 - RNA, 19 nt, synthetic construct
  misc_feature 1..19: note = siRNA Sense Sequence
  source 1..19: mol_type = other RNA
attatgcccgtgtttcaag

SEQ ID NO: 1768 - RNA, 19 nt, synthetic construct
  misc_feature 1..19: note = siRNA Antisense Sequence
  source 1..19: mol_type = other RNA
cttgaaacacgggcataat

SEQ ID NO: 1769 - RNA, 19 nt, synthetic construct
  misc_feature 1..19: note = siRNA Sense Sequence
  source 1..19: mol_type = other RNA
ttatgcccgtgtttcaagg

SEQ ID NO: 1770 - RNA, 19 nt, synthetic construct
  misc_feature 1..19: note = siRNA Antisense Sequence
  source 1..19: mol_type = other RNA
ccttgaaacacgggcataa

SEQ ID NO: 1771 - RNA, 19 nt, synthetic construct
  misc_feature 1..19: note = siRNA Sense Sequence
  source 1..19: mol_type = other RNA
tatgcccgtgtttcaaggt

SEQ ID NO: 1772 - RNA, 19 nt, synthetic construct
  misc_feature 1..19: note = siRNA Antisense Sequence
  source 1..19: mol_type = other RNA
accttgaaacacgggcata

SEQ ID NO: 1773 - RNA, 19 nt, synthetic construct
  misc_feature 1..19: note = siRNA Sense Sequence
  source 1..19: mol_type = other RNA
atgcccgtgtttcaaggtt

SEQ ID NO: 1774 - RNA, 19 nt, synthetic construct
  misc_feature 1..19: note = siRNA Antisense Sequence
  source 1..19: mol_type = other RNA
aaccttgaaacacgggcat

SEQ ID NO: 1775 - RNA, 19 nt, synthetic construct
  misc_feature 1..19: note = siRNA Sense Sequence
  source 1..19: mol_type = other RNA
tgcccgtgtttcaaggttt

SEQ ID NO: 1776 - RNA, 19 nt, synthetic construct
  misc_feature 1..19: note = siRNA Antisense Sequence
  source 1..19: mol_type = other RNA
aaaccttgaaacacgggca

SEQ ID NO: 1777 - RNA, 19 nt, synthetic construct
  misc_feature 1..19: note = siRNA Sense Sequence
  source 1..19: mol_type = other RNA
caaggtttgaatgagctga

SEQ ID NO: 1778 - RNA, 19 nt, synthetic construct
  misc_feature 1..19: note = siRNA Antisense Sequence
  source 1..19: mol_type = other RNA
tcagctcattcaaaccttg

SEQ ID NO: 1779 - RNA, 19 nt, synthetic construct
  misc_feature 1..19: note = siRNA Sense Sequence
  source 1..19: mol_type = other RNA
ctgattcctatgtataagt

SEQ ID NO: 1780 - RNA, 19 nt, synthetic construct
  misc_feature 1..19: note = siRNA Antisense Sequence
  source 1..19: mol_type = other RNA
acttatacataggaatcag

SEQ ID NO: 1781 - RNA, 19 nt, synthetic construct
  misc_feature 1..19: note = siRNA Sense Sequence
  source 1..19: mol_type = other RNA
cctatgtataagttaatgg

SEQ ID NO: 1782 - RNA, 19 nt, synthetic construct
  misc_feature 1..19: note = siRNA Antisense Sequence
  source 1..19: mol_type = other RNA
ccattaacttatacatagg

SEQ ID NO: 1783 - RNA, 19 nt, synthetic construct
  misc_feature 1..19: note = siRNA Sense Sequence
  source 1..19: mol_type = other RNA
aactcaattcaaggccttc

SEQ ID NO: 1784 - RNA, 19 nt, synthetic construct
  misc_feature 1..19: note = siRNA Antisense Sequence
  source 1..19: mol_type = other RNA
gaaggccttgaattgagtt

SEQ ID NO: 1785 - RNA, 19 nt, synthetic construct
  misc_feature 1..19: note = siRNA Sense Sequence
  source 1..19: mol_type = other RNA
actcaattcaaggccttcc

SEQ ID NO: 1786 - RNA, 19 nt, synthetic construct
  misc_feature 1..19: note = siRNA Antisense Sequence
  source 1..19: mol_type = other RNA
ggaaggccttgaattgagt

SEQ ID NO: 1787 - RNA, 19 nt, synthetic construct
  misc_feature 1..19: note = siRNA Sense Sequence
  source 1..19: mol_type = other RNA
ctcaattcaaggccttcct

SEQ ID NO: 1788 - RNA, 19 nt, synthetic construct
  misc_feature 1..19: note = siRNA Antisense Sequence
  source 1..19: mol_type = other RNA
aggaaggccttgaattgag

SEQ ID NO: 1789 - RNA, 19 nt, synthetic construct
  misc_feature 1..19: note = siRNA Sense Sequence
  source 1..19: mol_type = other RNA
tcaattcaaggccttcctc

SEQ ID NO: 1790 - RNA, 19 nt, synthetic construct
  misc_feature 1..19: note = siRNA Antisense Sequence
  source 1..19: mol_type = other RNA
gaggaaggccttgaattga

SEQ ID NO: 1791 - RNA, 19 nt, synthetic construct
  misc_feature 1..19: note = siRNA Sense Sequence
  source 1..19: mol_type = other RNA
ttcaaggccttcctcatca

SEQ ID NO: 1792 - RNA, 19 nt, synthetic construct
  misc_feature 1..19: note = siRNA Antisense Sequence
  source 1..19: mol_type = other RNA
tgatgaggaaggccttgaa

SEQ ID NO: 1793 - RNA, 19 nt, synthetic construct
  misc_feature 1..19: note = siRNA Sense Sequence
  source 1..19: mol_type = other RNA
tcctcatcaggctgctaag

SEQ ID NO: 1794 - RNA, 19 nt, synthetic construct
  misc_feature 1..19: note = siRNA Antisense Sequence
  source 1..19: mol_type = other RNA
cttagcagcctgatgagga

SEQ ID NO: 1795 - RNA, 19 nt, synthetic construct
  misc_feature 1..19: note = siRNA Sense Sequence
  source 1..19: mol_type = other RNA
cctcatcaggctgctaagg

SEQ ID NO: 1796 - RNA, 19 nt, synthetic construct
  misc_feature 1..19: note = siRNA Antisense Sequence
  source 1..19: mol_type = other RNA
ccttagcagcctgatgagg

SEQ ID NO: 1797 - RNA, 19 nt, synthetic construct
  misc_feature 1..19: note = siRNA Sense Sequence
  source 1..19: mol_type = other RNA
tcaggctgctaagggacct

SEQ ID NO: 1798 - RNA, 19 nt, synthetic construct
  misc_feature 1..19: note = siRNA Antisense Sequence
  source 1..19: mol_type = other RNA
aggtcccttagcagcctga

SEQ ID NO: 1799 - RNA, 19 nt, synthetic construct
  misc_feature 1..19: note = siRNA Sense Sequence
  source 1..19: mol_type = other RNA
caggctgctaagggacctc

SEQ ID NO: 1800 - RNA, 19 nt, synthetic construct
  misc_feature 1..19: note = siRNA Antisense Sequence
  source 1..19: mol_type = other RNA
gaggtcccttagcagcctg

SEQ ID NO: 1801 - RNA, 19 nt, synthetic construct
  misc_feature 1..19: note = siRNA Sense Sequence
  source 1..19: mol_type = other RNA
aggctgctaagggacctca

SEQ ID NO: 1802 - RNA, 19 nt, synthetic construct
  misc_feature 1..19: note = siRNA Antisense Sequence
  source 1..19: mol_type = other RNA
tgaggtcccttagcagcct

SEQ ID NO: 1803 - RNA, 19 nt, synthetic construct
  misc_feature 1..19: note = siRNA Sense Sequence
  source 1..19: mol_type = other RNA
ggctgctaagggacctcat

SEQ ID NO: 1804 - RNA, 19 nt, synthetic construct
  misc_feature 1..19: note = siRNA Antisense Sequence
  source 1..19: mol_type = other RNA
atgaggtcccttagcagcc

SEQ ID NO: 1805 - RNA, 19 nt, synthetic construct
  misc_feature 1..19: note = siRNA Sense Sequence
  source 1..19: mol_type = other RNA
gctgctaagggacctcatt

SEQ ID NO: 1806 - RNA, 19 nt, synthetic construct
  misc_feature 1..19: note = siRNA Antisense Sequence
  source 1..19: mol_type = other RNA
aatgaggtcccttagcagc

SEQ ID NO: 1807 - RNA, 19 nt, synthetic construct
  misc_feature 1..19: note = siRNA Sense Sequence
  source 1..19: mol_type = other RNA
ctgctaagggacctcattg

SEQ ID NO: 1808 - RNA, 19 nt, synthetic construct
  misc_feature 1..19: note = siRNA Antisense Sequence
  source 1..19: mol_type = other RNA
caatgaggtcccttagcag

SEQ ID NO: 1809 - RNA, 19 nt, synthetic construct
  misc_feature 1..19: note = siRNA Sense Sequence
  source 1..19: mol_type = other RNA
tgctaagggacctcattga

SEQ ID NO: 1810 - RNA, 19 nt, synthetic construct
  misc_feature 1..19: note = siRNA Antisense Sequence
  source 1..19: mol_type = other RNA
tcaatgaggtcccttagca

SEQ ID NO: 1811 - RNA, 19 nt, synthetic construct
  misc_feature 1..19: note = siRNA Sense Sequence
  source 1..19: mol_type = other RNA
gctaagggacctcattgat

SEQ ID NO: 1812 - RNA, 19 nt, synthetic construct
  misc_feature 1..19: note = siRNA Antisense Sequence
  source 1..19: mol_type = other RNA
atcaatgaggtcccttagc

SEQ ID NO: 1813 - RNA, 19 nt, synthetic construct
  misc_feature 1..19: note = siRNA Sense Sequence
  source 1..19: mol_type = other RNA
ctaagggacctcattgata

SEQ ID NO: 1814 - RNA, 19 nt, synthetic construct
  misc_feature 1..19: note = siRNA Antisense Sequence
  source 1..19: mol_type = other RNA
tatcaatgaggtcccttag

SEQ ID NO: 1815 - RNA, 19 nt, synthetic construct
  misc_feature 1..19: note = siRNA Sense Sequence
  source 1..19: mol_type = other RNA
aagggacctcattgataag

SEQ ID NO: 1816 - RNA, 19 nt, synthetic construct
  misc_feature 1..19: note = siRNA Antisense Sequence
  source 1..19: mol_type = other RNA
cttatcaatgaggtccctt

SEQ ID NO: 1817 - RNA, 19 nt, synthetic construct
  misc_feature 1..19: note = siRNA Sense Sequence
  source 1..19: mol_type = other RNA
agggacctcattgataagc

SEQ ID NO: 1818 - RNA, 19 nt, synthetic construct
  misc_feature 1..19: note = siRNA Antisense Sequence
  source 1..19: mol_type = other RNA
gcttatcaatgaggtccct

SEQ ID NO: 1819 - RNA, 19 nt, synthetic construct
  misc_feature 1..19: note = siRNA Sense Sequence
  source 1..19: mol_type = other RNA
gggacctcattgataagca

SEQ ID NO: 1820 - RNA, 19 nt, synthetic construct
  misc_feature 1..19: note = siRNA Antisense Sequence
  source 1..19: mol_type = other RNA
tgcttatcaatgaggtccc

SEQ ID NO: 1821 - RNA, 19 nt, synthetic construct
  misc_feature 1..19: note = siRNA Sense Sequence
  source 1..19: mol_type = other RNA
ggacctcattgataagcag

SEQ ID NO: 1822 - RNA, 19 nt, synthetic construct
  misc_feature 1..19: note = siRNA Antisense Sequence
  source 1..19: mol_type = other RNA
ctgcttatcaatgaggtcc

SEQ ID NO: 1823 - RNA, 19 nt, synthetic construct
  misc_feature 1..19: note = siRNA Sense Sequence
  source 1..19: mol_type = other RNA
gacctcattgataagcaga

SEQ ID NO: 1824 - RNA, 19 nt, synthetic construct
  misc_feature 1..19: note = siRNA Antisense Sequence
  source 1..19: mol_type = other RNA
tctgcttatcaatgaggtc

SEQ ID NO: 1825 - RNA, 19 nt, synthetic construct
  misc_feature 1..19: note = siRNA Sense Sequence
  source 1..19: mol_type = other RNA
attgataagcagacatgga

SEQ ID NO: 1826 - RNA, 19 nt, synthetic construct
  misc_feature 1..19: note = siRNA Antisense Sequence
  source 1..19: mol_type = other RNA
tccatgtctgcttatcaat

SEQ ID NO: 1827 - RNA, 19 nt, synthetic construct
  misc_feature 1..19: note = siRNA Sense Sequence
  source 1..19: mol_type = other RNA
gataagcagacatggacag

SEQ ID NO: 1828 - RNA, 19 nt, synthetic construct
  misc_feature 1..19: note = siRNA Antisense Sequence
  source 1..19: mol_type = other RNA
ctgtccatgtctgcttatc

SEQ ID NO: 1829 - RNA, 19 nt, synthetic construct
  misc_feature 1..19: note = siRNA Sense Sequence
  source 1..19: mol_type = other RNA
ataagcagacatggacaga

SEQ ID NO: 1830 - RNA, 19 nt, synthetic construct
  misc_feature 1..19: note = siRNA Antisense Sequence
  source 1..19: mol_type = other RNA
tctgtccatgtctgcttat

SEQ ID NO: 1831 - RNA, 19 nt, synthetic construct
  misc_feature 1..19: note = siRNA Sense Sequence
  source 1..19: mol_type = other RNA
taagcagacatggacagac

SEQ ID NO: 1832 - RNA, 19 nt, synthetic construct
  misc_feature 1..19: note = siRNA Antisense Sequence
  source 1..19: mol_type = other RNA
gtctgtccatgtctgctta

SEQ ID NO: 1833 - RNA, 19 nt, synthetic construct
  misc_feature 1..19: note = siRNA Sense Sequence
  source 1..19: mol_type = other RNA
agcagacatggacagacga

SEQ ID NO: 1834 - RNA, 19 nt, synthetic construct
  misc_feature 1..19: note = siRNA Antisense Sequence
  source 1..19: mol_type = other RNA
tcgtctgtccatgtctgct

SEQ ID NO: 1835 - RNA, 19 nt, synthetic construct
  misc_feature 1..19: note = siRNA Sense Sequence
  source 1..19: mol_type = other RNA
gcagacatggacagacgag

SEQ ID NO: 1836 - RNA, 19 nt, synthetic construct
  misc_feature 1..19: note = siRNA Antisense Sequence
  source 1..19: mol_type = other RNA
ctcgtctgtccatgtctgc

SEQ ID NO: 1837 - RNA, 19 nt, synthetic construct
  misc_feature 1..19: note = siRNA Sense Sequence
  source 1..19: mol_type = other RNA
cagacatggacagacgagg

SEQ ID NO: 1838 - RNA, 19 nt, synthetic construct
  misc_feature 1..19: note = siRNA Antisense Sequence
  source 1..19: mol_type = other RNA
cctcgtctgtccatgtctg

SEQ ID NO: 1839 - RNA, 19 nt, synthetic construct
  misc_feature 1..19: note = siRNA Sense Sequence
  source 1..19: mol_type = other RNA
agacatggacagacgaggg

SEQ ID NO: 1840 - RNA, 19 nt, synthetic construct
  misc_feature 1..19: note = siRNA Antisense Sequence
  source 1..19: mol_type = other RNA
ccctcgtctgtccatgtct

SEQ ID NO: 1841 - RNA, 19 nt, synthetic construct
  misc_feature 1..19: note = siRNA Sense Sequence
  source 1..19: mol_type = other RNA
gacatggacagacgagggc

SEQ ID NO: 1842 - RNA, 19 nt, synthetic construct
  misc_feature 1..19: note = siRNA Antisense Sequence
  source 1..19: mol_type = other RNA
gccctcgtctgtccatgtc

SEQ ID NO: 1843 - RNA, 19 nt, synthetic construct
  misc_feature 1..19: note = siRNA Sense Sequence
  source 1..19: mol_type = other RNA
tggacagacgagggctcag

SEQ ID NO: 1844 - RNA, 19 nt, synthetic construct
  misc_feature 1..19: note = siRNA Antisense Sequence
  source 1..19: mol_type = other RNA
ctgagccctcgtctgtcca

SEQ ID NO: 1845 - RNA, 19 nt, synthetic construct
  misc_feature 1..19: note = siRNA Sense Sequence
  source 1..19: mol_type = other RNA
gacagacgagggctcagtc

SEQ ID NO: 1846 - RNA, 19 nt, synthetic construct
  misc_feature 1..19: note = siRNA Antisense Sequence
  source 1..19: mol_type = other RNA
gactgagccctcgtctgtc

SEQ ID NO: 1847 - RNA, 19 nt, synthetic construct
  misc_feature 1..19: note = siRNA Sense Sequence
  source 1..19: mol_type = other RNA
gacgagggctcagtctcag

SEQ ID NO: 1848 - RNA, 19 nt, synthetic construct
  misc_feature 1..19: note = siRNA Antisense Sequence
  source 1..19: mol_type = other RNA
ctgagactgagccctcgtc

SEQ ID NO: 1849 - RNA, 19 nt, synthetic construct
  misc_feature 1..19: note = siRNA Sense Sequence
  source 1..19: mol_type = other RNA
acgagggctcagtctcaga

SEQ ID NO: 1850 - RNA, 19 nt, synthetic construct
  misc_feature 1..19: note = siRNA Antisense Sequence
  source 1..19: mol_type = other RNA
tctgagactgagccctcgt

SEQ ID NO: 1851 - RNA, 19 nt, synthetic construct
  misc_feature 1..19: note = siRNA Sense Sequence
  source 1..19: mol_type = other RNA
aactactactcctcgcctg

SEQ ID NO: 1852 - RNA, 19 nt, synthetic construct
  misc_feature 1..19: note = siRNA Antisense Sequence
  source 1..19: mol_type = other RNA
caggcgaggagtagtagtt

SEQ ID NO: 1853 - RNA, 19 nt, synthetic construct
  misc_feature 1..19: note = siRNA Sense Sequence
  source 1..19: mol_type = other RNA
actactactcctcgcctgt

SEQ ID NO: 1854 - RNA, 19 nt, synthetic construct
  misc_feature 1..19: note = siRNA Antisense Sequence
  source 1..19: mol_type = other RNA
acaggcgaggagtagtagt

SEQ ID NO: 1855 - RNA, 19 nt, synthetic construct
  misc_feature 1..19: note = siRNA Sense Sequence
  source 1..19: mol_type = other RNA
ctactactcctcgcctgtg

SEQ ID NO: 1856 - RNA, 19 nt, synthetic construct
  misc_feature 1..19: note = siRNA Antisense Sequence
  source 1..19: mol_type = other RNA
cacaggcgaggagtagtag

SEQ ID NO: 1857 - RNA, 19 nt, synthetic construct
  misc_feature 1..19: note = siRNA Sense Sequence
  source 1..19: mol_type = other RNA
tactactcctcgcctgtgt

SEQ ID NO: 1858 - RNA, 19 nt, synthetic construct
  misc_feature 1..19: note = siRNA Antisense Sequence
  source 1..19: mol_type = other RNA
acacaggcgaggagtagta

SEQ ID NO: 1859 - RNA, 19 nt, synthetic construct
  misc_feature 1..19: note = siRNA Sense Sequence
  source 1..19: mol_type = other RNA
actactcctcgcctgtgtg

SEQ ID NO: 1860 - RNA, 19 nt, synthetic construct
  misc_feature 1..19: note = siRNA Antisense Sequence
  source 1..19: mol_type = other RNA
cacacaggcgaggagtagt

SEQ ID NO: 1861 - RNA, 19 nt, synthetic construct
  misc_feature 1..19: note = siRNA Sense Sequence
  source 1..19: mol_type = other RNA
ctactcctcgcctgtgtgc

SEQ ID NO: 1862 - RNA, 19 nt, synthetic construct
  misc_feature 1..19: note = siRNA Antisense Sequence
  source 1..19: mol_type = other RNA
gcacacaggcgaggagtag

SEQ ID NO: 1863 - RNA, 19 nt, synthetic construct
  misc_feature 1..19: note = siRNA Sense Sequence
  source 1..19: mol_type = other RNA
tactcctcgcctgtgtgca

SEQ ID NO: 1864 - RNA, 19 nt, synthetic construct
  misc_feature 1..19: note = siRNA Antisense Sequence
  source 1..19: mol_type = other RNA
tgcacacaggcgaggagta

SEQ ID NO: 1865 - RNA, 19 nt, synthetic construct
  misc_feature 1..19: note = siRNA Sense Sequence
  source 1..19: mol_type = other RNA
actcctcgcctgtgtgcac

SEQ ID NO: 1866 - RNA, 19 nt, synthetic construct
  misc_feature 1..19: note = siRNA Antisense Sequence
  source 1..19: mol_type = other RNA
gtgcacacaggcgaggagt

SEQ ID NO: 1867 - RNA, 19 nt, synthetic construct
  misc_feature 1..19: note = siRNA Sense Sequence
  source 1..19: mol_type = other RNA
tacagagggcagaaggcta

SEQ ID NO: 1868 - RNA, 19 nt, synthetic construct
  misc_feature 1..19: note = siRNA Antisense Sequence
  source 1..19: mol_type = other RNA
tagccttctgccctctgta

SEQ ID NO: 1869 - RNA, 19 nt, synthetic construct
  misc_feature 1..19: note = siRNA Sense Sequence
  source 1..19: mol_type = other RNA
acagagggcagaaggctat

SEQ ID NO: 1870 - RNA, 19 nt, synthetic construct
  misc_feature 1..19: note = siRNA Antisense Sequence
  source 1..19: mol_type = other RNA
atagccttctgccctctgt

SEQ ID NO: 1871 - RNA, 19 nt, synthetic construct
  misc_feature 1..19: note = siRNA Sense Sequence
  source 1..19: mol_type = other RNA
agagggcagaaggctattt

SEQ ID NO: 1872 - RNA, 19 nt, synthetic construct
  misc_feature 1..19: note = siRNA Antisense Sequence
  source 1..19: mol_type = other RNA
aaatagccttctgccctct

SEQ ID NO: 1873 - RNA, 19 nt, synthetic construct
  misc_feature 1..19: note = siRNA Sense Sequence
  source 1..19: mol_type = other RNA
gagggcagaaggctatttc

SEQ ID NO: 1874 - RNA, 19 nt, synthetic construct
  misc_feature 1..19: note = siRNA Antisense Sequence
  source 1..19: mol_type = other RNA
gaaatagccttctgccctc

SEQ ID NO: 1875 - RNA, 19 nt, synthetic construct
  misc_feature 1..19: note = siRNA Sense Sequence
  source 1..19: mol_type = other RNA
gcagaaggctatttcagaa

SEQ ID NO: 1876 - RNA, 19 nt, synthetic construct
  misc_feature 1..19: note = siRNA Antisense Sequence
  source 1..19: mol_type = other RNA
ttctgaaatagccttctgc

SEQ ID NO: 1877 - RNA, 19 nt, synthetic construct
  misc_feature 1..19: note = siRNA Sense Sequence
  source 1..19: mol_type = other RNA
cctgtcgacgtgaccttgg

SEQ ID NO: 1878 - RNA, 19 nt, synthetic construct
  misc_feature 1..19: note = siRNA Antisense Sequence
  source 1..19: mol_type = other RNA
ccaaggtcacgtcgacagg

SEQ ID NO: 1879 - RNA, 19 nt, synthetic construct
  misc_feature 1..19: note = siRNA Sense Sequence
  source 1..19: mol_type = other RNA
ctgtcgacgtgaccttggc

SEQ ID NO: 1880 - RNA, 19 nt, synthetic construct
  misc_feature 1..19: note = siRNA Antisense Sequence
  source 1..19: mol_type = other RNA
gccaaggtcacgtcgacag

SEQ ID NO: 1881 - RNA, 19 nt, synthetic construct
  misc_feature 1..19: note = siRNA Sense Sequence
  source 1..19: mol_type = other RNA
tgtcgacgtgaccttggca

SEQ ID NO: 1882 - RNA, 19 nt, synthetic construct
  misc_feature 1..19: note = siRNA Antisense Sequence
  source 1..19: mol_type = other RNA
tgccaaggtcacgtcgaca

SEQ ID NO: 1883 - RNA, 19 nt, synthetic construct
  misc_feature 1..19: note = siRNA Sense Sequence
  source 1..19: mol_type = other RNA
gtcgacgtgaccttggcag

SEQ ID NO: 1884 - RNA, 19 nt, synthetic construct
  misc_feature 1..19: note = siRNA Antisense Sequence
  source 1..19: mol_type = other RNA
ctgccaaggtcacgtcgac

SEQ ID NO: 1885 - RNA, 19 nt, synthetic construct
  misc_feature 1..19: note = siRNA Sense Sequence
  source 1..19: mol_type = other RNA
tcgacgtgaccttggcagt

SEQ ID NO: 1886 - RNA, 19 nt, synthetic construct
  misc_feature 1..19: note = siRNA Antisense Sequence
  source 1..19: mol_type = other RNA
actgccaaggtcacgtcga

SEQ ID NO: 1887 - RNA, 19 nt, synthetic construct
  misc_feature 1..19: note = siRNA Sense Sequence
  source 1..19: mol_type = other RNA
tgaccttggcagtgtttgc

SEQ ID NO: 1888 - RNA, 19 nt, synthetic construct
  misc_feature 1..19: note = siRNA Antisense Sequence
  source 1..19: mol_type = other RNA
gcaaacactgccaaggtca

SEQ ID NO: 1889 - RNA, 19 nt, synthetic construct
  misc_feature 1..19: note = siRNA Sense Sequence
  source 1..19: mol_type = other RNA
ccttggcagtgtttgctgt

SEQ ID NO: 1890 - RNA, 19 nt, synthetic construct
  misc_feature 1..19: note = siRNA Antisense Sequence
  source 1..19: mol_type = other RNA
acagcaaacactgccaagg

SEQ ID NO: 1891 - RNA, 19 nt, synthetic construct
  misc_feature 1..19: note = siRNA Sense Sequence
  source 1..19: mol_type = other RNA
ttggcagtgtttgctgtgg

SEQ ID NO: 1892 - RNA, 19 nt, synthetic construct
  misc_feature 1..19: note = siRNA Antisense Sequence
  source 1..19: mol_type = other RNA
ccacagcaaacactgccaa

SEQ ID NO: 1893 - RNA, 19 nt, synthetic construct
  misc_feature 1..19: note = siRNA Sense Sequence
  source 1..19: mol_type = other RNA
tggcagtgtttgctgtggg

SEQ ID NO: 1894 - RNA, 19 nt, synthetic construct
  misc_feature 1..19: note = siRNA Antisense Sequence
  source 1..19: mol_type = other RNA
cccacagcaaacactgcca

SEQ ID NO: 1895 - RNA, 19 nt, synthetic construct
  misc_feature 1..19: note = siRNA Sense Sequence
  source 1..19: mol_type = other RNA
cagagcacagaaggctggg

SEQ ID NO: 1896 - RNA, 19 nt, synthetic construct
  misc_feature 1..19: note = siRNA Antisense Sequence
  source 1..19: mol_type = other RNA
cccagccttctgtgctctg

SEQ ID NO: 1897 - RNA, 19 nt, synthetic construct
  misc_feature 1..19: note = siRNA Sense Sequence
  source 1..19: mol_type = other RNA
agagcacagaaggctggga

SEQ ID NO: 1898 - RNA, 19 nt, synthetic construct
  misc_feature 1..19: note = siRNA Antisense Sequence
  source 1..19: mol_type = other RNA
tcccagccttctgtgctct

SEQ ID NO: 1899 - RNA, 19 nt, synthetic construct
  misc_feature 1..19: note = siRNA Sense Sequence
  source 1..19: mol_type = other RNA
gagcacagaaggctgggat

SEQ ID NO: 1900 - RNA, 19 nt, synthetic construct
  misc_feature 1..19: note = siRNA Antisense Sequence
  source 1..19: mol_type = other RNA
atcccagccttctgtgctc

SEQ ID NO: 1901 - RNA, 19 nt, synthetic construct
  misc_feature 1..19: note = siRNA Sense Sequence
  source 1..19: mol_type = other RNA
agcacagaaggctgggatt

SEQ ID NO: 1902 - RNA, 19 nt, synthetic construct
  misc_feature 1..19: note = siRNA Antisense Sequence
  source 1..19: mol_type = other RNA
aatcccagccttctgtgct

SEQ ID NO: 1903 - RNA, 19 nt, synthetic construct
  misc_feature 1..19: note = siRNA Sense Sequence
  source 1..19: mol_type = other RNA
gcacagaaggctgggattt

SEQ ID NO: 1904 - RNA, 19 nt, synthetic construct
  misc_feature 1..19: note = siRNA Antisense Sequence
  source 1..19: mol_type = other RNA
aaatcccagccttctgtgc

SEQ ID NO: 1905 - RNA, 19 nt, synthetic construct
  misc_feature 1..19: note = siRNA Sense Sequence
  source 1..19: mol_type = other RNA
acagaaggctgggattttc

SEQ ID NO: 1906 - RNA, 19 nt, synthetic construct
  misc_feature 1..19: note = siRNA Antisense Sequence
  source 1..19: mol_type = other RNA
gaaaatcccagccttctgt

SEQ ID NO: 1907 - RNA, 19 nt, synthetic construct
  misc_feature 1..19: note = siRNA Sense Sequence
  source 1..19: mol_type = other RNA
agttttctttgtccagtac

SEQ ID NO: 1908 - RNA, 19 nt, synthetic construct
  misc_feature 1..19: note = siRNA Antisense Sequence
  source 1..19: mol_type = other RNA
gtactggacaaagaaaact

SEQ ID NO: 1909 - RNA, 19 nt, synthetic construct
  misc_feature 1..19: note = siRNA Sense Sequence
  source 1..19: mol_type = other RNA
gttttctttgtccagtact

SEQ ID NO: 1910 - RNA, 19 nt, synthetic construct
  misc_feature 1..19: note = siRNA Antisense Sequence
  source 1..19: mol_type = other RNA
agtactggacaaagaaaac

SEQ ID NO: 1911 - RNA, 19 nt, synthetic construct
  misc_feature 1..19: note = siRNA Sense Sequence
  source 1..19: mol_type = other RNA
ttttctttgtccagtactg

SEQ ID NO: 1912 - RNA, 19 nt, synthetic construct
  misc_feature 1..19: note = siRNA Antisense Sequence
  source 1..19: mol_type = other RNA
cagtactggacaaagaaaa

SEQ ID NO: 1913 - RNA, 19 nt, synthetic construct
  misc_feature 1..19: note = siRNA Sense Sequence
  source 1..19: mol_type = other RNA
tttctttgtccagtactga

SEQ ID NO: 1914 - RNA, 19 nt, synthetic construct
  misc_feature 1..19: note = siRNA Antisense Sequence
  source 1..19: mol_type = other RNA
tcagtactggacaaagaaa

SEQ ID NO: 1915 - RNA, 19 nt, synthetic construct
  misc_feature 1..19: note = siRNA Sense Sequence
  source 1..19: mol_type = other RNA
ttctttgtccagtactgag

SEQ ID NO: 1916 - RNA, 19 nt, synthetic construct
  misc_feature 1..19: note = siRNA Antisense Sequence
  source 1..19: mol_type = other RNA
ctcagtactggacaaagaa

SEQ ID NO: 1917 - RNA, 19 nt, synthetic construct
  misc_feature 1..19: note = siRNA Sense Sequence
  source 1..19: mol_type = other RNA
aaaagcttcaatggctact

SEQ ID NO: 1918 - RNA, 19 nt, synthetic construct
  misc_feature 1..19: note = siRNA Antisense Sequence
  source 1..19: mol_type = other RNA
agtagccattgaagctttt

SEQ ID NO: 1919 - RNA, 19 nt, synthetic construct
  misc_feature 1..19: note = siRNA Sense Sequence
  source 1..19: mol_type = other RNA
aaagcttcaatggctacta

SEQ ID NO: 1920 - RNA, 19 nt, synthetic construct
  misc_feature 1..19: note = siRNA Antisense Sequence
  source 1..19: mol_type = other RNA
tagtagccattgaagcttt

SEQ ID NO: 1921 - RNA, 19 nt, synthetic construct
  misc_feature 1..19: note = siRNA Sense Sequence
  source 1..19: mol_type = other RNA
cttcaatggctactagatg

SEQ ID NO: 1922 - RNA, 19 nt, synthetic construct
  misc_feature 1..19: note = siRNA Antisense Sequence
  source 1..19: mol_type = other RNA
catctagtagccattgaag

SEQ ID NO: 1923 - RNA, 19 nt, synthetic construct
  misc_feature 1..19: note = siRNA Sense Sequence
  source 1..19: mol_type = other RNA
ttcaatggctactagatga

SEQ ID NO: 1924 - RNA, 19 nt, synthetic construct
  misc_feature 1..19: note = siRNA Antisense Sequence
  source 1..19: mol_type = other RNA
tcatctagtagccattgaa

SEQ ID NO: 1925 - RNA, 19 nt, synthetic construct
  misc_feature 1..19: note = siRNA Sense Sequence
  source 1..19: mol_type = other RNA
tcaatggctactagatgaa

SEQ ID NO: 1926 - RNA, 19 nt, synthetic construct
  misc_feature 1..19: note = siRNA Antisense Sequence
  source 1..19: mol_type = other RNA
ttcatctagtagccattga

SEQ ID NO: 1927 - RNA, 19 nt, synthetic construct
  misc_feature 1..19: note = siRNA Sense Sequence
  source 1..19: mol_type = other RNA
caaattcttacactcattg

SEQ ID NO: 1928 - RNA, 19 nt, synthetic construct
  misc_feature 1..19: note = siRNA Antisense Sequence
  source 1..19: mol_type = other RNA
caatgagtgtaagaatttg

SEQ ID NO: 1929 - RNA, 19 nt, synthetic construct
  misc_feature 1..19: note = siRNA Sense Sequence
  source 1..19: mol_type = other RNA
aaattcttacactcattgg

SEQ ID NO: 1930 - RNA, 19 nt, synthetic construct
  misc_feature 1..19: note = siRNA Antisense Sequence
  source 1..19: mol_type = other RNA
ccaatgagtgtaagaattt

SEQ ID NO: 1931 - RNA, 19 nt, synthetic construct
  misc_feature 1..19: note = siRNA Sense Sequence
  source 1..19: mol_type = other RNA
aattcttacactcattggc

SEQ ID NO: 1932 - RNA, 19 nt, synthetic construct
  misc_feature 1..19: note = siRNA Antisense Sequence
  source 1..19: mol_type = other RNA
gccaatgagtgtaagaatt

SEQ ID NO: 1933 - RNA, 19 nt, synthetic construct
  misc_feature 1..19: note = siRNA Sense Sequence
  source 1..19: mol_type = other RNA
attcttacactcattggca

SEQ ID NO: 1934 - RNA, 19 nt, synthetic construct
  misc_feature 1..19: note = siRNA Antisense Sequence
  source 1..19: mol_type = other RNA
tgccaatgagtgtaagaat

SEQ ID NO: 1935 - RNA, 19 nt, synthetic construct
  misc_feature 1..19: note = siRNA Sense Sequence
  source 1..19: mol_type = other RNA
ttcttacactcattggcag

SEQ ID NO: 1936 - RNA, 19 nt, synthetic construct
  misc_feature 1..19: note = siRNA Antisense Sequence
  source 1..19: mol_type = other RNA
ctgccaatgagtgtaagaa

SEQ ID NO: 1937 - RNA, 19 nt, synthetic construct
  misc_feature 1..19: note = siRNA Sense Sequence
  source 1..19: mol_type = other RNA
tcttacactcattggcagg

SEQ ID NO: 1938 - RNA, 19 nt, synthetic construct
  misc_feature 1..19: note = siRNA Antisense Sequence
  source 1..19: mol_type = other RNA
cctgccaatgagtgtaaga

SEQ ID NO: 1939 - RNA, 19 nt, synthetic construct
  misc_feature 1..19: note = siRNA Sense Sequence
  source 1..19: mol_type = other RNA
cttacactcattggcagga

SEQ ID NO: 1940 - RNA, 19 nt, synthetic construct
  misc_feature 1..19: note = siRNA Antisense Sequence
  source 1..19: mol_type = other RNA
tcctgccaatgagtgtaag

SEQ ID NO: 1941 - RNA, 19 nt, synthetic construct
  misc_feature 1..19: note = siRNA Sense Sequence
  source 1..19: mol_type = other RNA
ttacactcattggcaggaa

SEQ ID NO: 1942 - RNA, 19 nt, synthetic construct
  misc_feature 1..19: note = siRNA Antisense Sequence
  source 1..19: mol_type = other RNA
ttcctgccaatgagtgtaa

SEQ ID NO: 1943 - RNA, 19 nt, synthetic construct
  misc_feature 1..19: note = siRNA Sense Sequence
  source 1..19: mol_type = other RNA
tggcctggcaatttctgag

SEQ ID NO: 1944 - RNA, 19 nt, synthetic construct
  misc_feature 1..19: note = siRNA Antisense Sequence
  source 1..19: mol_type = other RNA
ctcagaaattgccaggcca

SEQ ID NO: 1945 - RNA, 19 nt, synthetic construct
  misc_feature 1..19: note = siRNA Sense Sequence
  source 1..19: mol_type = other RNA
ggcctggcaatttctgagg

SEQ ID NO: 1946 - RNA, 19 nt, synthetic construct
  misc_feature 1..19: note = siRNA Antisense Sequence
  source 1..19: mol_type = other RNA
cctcagaaattgccaggcc

SEQ ID NO: 1947 - RNA, 19 nt, synthetic construct
  misc_feature 1..19: note = siRNA Sense Sequence
  source 1..19: mol_type = other RNA
gcctggcaatttctgagga

SEQ ID NO: 1948 - RNA, 19 nt, synthetic construct
  misc_feature 1..19: note = siRNA Antisense Sequence
  source 1..19: mol_type = other RNA
tcctcagaaattgccaggc

SEQ ID NO: 1949 - RNA, 19 nt, synthetic construct
  misc_feature 1..19: note = siRNA Sense Sequence
  source 1..19: mol_type = other RNA
acttggctcatcttccata

SEQ ID NO: 1950 - RNA, 19 nt, synthetic construct
  misc_feature 1..19: note = siRNA Antisense Sequence
  source 1..19: mol_type = other RNA
tatggaagatgagccaagt

SEQ ID NO: 1951 - RNA, 19 nt, synthetic construct
  misc_feature 1..19: note = siRNA Sense Sequence
  source 1..19: mol_type = other RNA
cttggctcatcttccatag

SEQ ID NO: 1952 - RNA, 19 nt, synthetic construct
  misc_feature 1..19: note = siRNA Antisense Sequence
  source 1..19: mol_type = other RNA
ctatggaagatgagccaag

SEQ ID NO: 1953 - RNA, 19 nt, synthetic construct
  misc_feature 1..19: note = siRNA Sense Sequence
  source 1..19: mol_type = other RNA
gctcatcttccatagccca

SEQ ID NO: 1954 - RNA, 19 nt, synthetic construct
  misc_feature 1..19: note = siRNA Antisense Sequence
  source 1..19: mol_type = other RNA
tgggctatggaagatgagc

SEQ ID NO: 1955 - RNA, 19 nt, synthetic construct
  misc_feature 1..19: note = siRNA Sense Sequence
  source 1..19: mol_type = other RNA
ctcatcttccatagcccac

SEQ ID NO: 1956 - RNA, 19 nt, synthetic construct
  misc_feature 1..19: note = siRNA Antisense Sequence
  source 1..19: mol_type = other RNA
gtgggctatggaagatgag

SEQ ID NO: 1957 - RNA, 19 nt, synthetic construct
  misc_feature 1..19: note = siRNA Sense Sequence
  source 1..19: mol_type = other RNA
catagcccacatggtaatg

SEQ ID NO: 1958 - RNA, 19 nt, synthetic construct
  misc_feature 1..19: note = siRNA Antisense Sequence
  source 1..19: mol_type = other RNA
cattaccatgtgggctatg

SEQ ID NO: 1959 - RNA, 19 nt, synthetic construct
  misc_feature 1..19: note = siRNA Sense Sequence
  source 1..19: mol_type = other RNA
atagcccacatggtaatgg

SEQ ID NO: 1960 - RNA, 19 nt, synthetic construct
  misc_feature 1..19: note = siRNA Antisense Sequence
  source 1..19: mol_type = other RNA
ccattaccatgtgggctat

SEQ ID NO: 1961 - RNA, 19 nt, synthetic construct
  misc_feature 1..19: note = siRNA Sense Sequence
  source 1..19: mol_type = other RNA
ccacatggtaatgggtaca

SEQ ID NO: 1962 - RNA, 19 nt, synthetic construct
  misc_feature 1..19: note = siRNA Antisense Sequence
  source 1..19: mol_type = other RNA
tgtacccattaccatgtgg

SEQ ID NO: 1963 - RNA, 19 nt, synthetic construct
  misc_feature 1..19: note = siRNA Sense Sequence
  source 1..19: mol_type = other RNA
acacggcttgaagaggtaa

SEQ ID NO: 1964 - RNA, 19 nt, synthetic construct
  misc_feature 1..19: note = siRNA Antisense Sequence
  source 1..19: mol_type = other RNA
ttacctcttcaagccgtgt

SEQ ID NO: 1965 - RNA, 19 nt, synthetic construct
  misc_feature 1..19: note = siRNA Sense Sequence
  source 1..19: mol_type = other RNA
cacggcttgaagaggtaaa

SEQ ID NO: 1966 - RNA, 19 nt, synthetic construct
  misc_feature 1..19: note = siRNA Antisense Sequence
  source 1..19: mol_type = other RNA
tttacctcttcaagccgtg

SEQ ID NO: 1967 - RNA, 19 nt, synthetic construct
  misc_feature 1..19: note = siRNA Sense Sequence
  source 1..19: mol_type = other RNA
acggcttgaagaggtaaaa

SEQ ID NO: 1968 - RNA, 19 nt, synthetic construct
  misc_feature 1..19: note = siRNA Antisense Sequence
  source 1..19: mol_type = other RNA
ttttacctcttcaagccgt

SEQ ID NO: 1969 - RNA, 19 nt, synthetic construct
  misc_feature 1..19: note = siRNA Sense Sequence
  source 1..19: mol_type = other RNA
cggcttgaagaggtaaaag

SEQ ID NO: 1970 - RNA, 19 nt, synthetic construct
  misc_feature 1..19: note = siRNA Antisense Sequence
  source 1..19: mol_type = other RNA
cttttacctcttcaagccg

SEQ ID NO: 1971 - RNA, 19 nt, synthetic construct
  misc_feature 1..19: note = siRNA Sense Sequence
  source 1..19: mol_type = other RNA
ggcttgaagaggtaaaagg

SEQ ID NO: 1972 - RNA, 19 nt, synthetic construct
  misc_feature 1..19: note = siRNA Antisense Sequence
  source 1..19: mol_type = other RNA
ccttttacctcttcaagcc

SEQ ID NO: 1973 - RNA, 19 nt, synthetic construct
  misc_feature 1..19: note = siRNA Sense Sequence
  source 1..19: mol_type = other RNA
gcttgaagaggtaaaagga

SEQ ID NO: 1974 - RNA, 19 nt, synthetic construct
  misc_feature 1..19: note = siRNA Antisense Sequence
  source 1..19: mol_type = other RNA
tccttttacctcttcaagc

SEQ ID NO: 1975 - RNA, 19 nt, synthetic construct
  misc_feature 1..19: note = siRNA Sense Sequence
  source 1..19: mol_type = other RNA
gaagaggtaaaaggattct

SEQ ID NO: 1976 - RNA, 19 nt, synthetic construct
  misc_feature 1..19: note = siRNA Antisense Sequence
  source 1..19: mol_type = other RNA
agaatccttttacctcttc

SEQ ID NO: 1977 - RNA, 19 nt, synthetic construct
  misc_feature 1..19: note = siRNA Sense Sequence
  source 1..19: mol_type = other RNA
agaggtaaaaggattcttc

SEQ ID NO: 1978 - RNA, 19 nt, synthetic construct
  misc_feature 1..19: note = siRNA Antisense Sequence
  source 1..19: mol_type = other RNA
gaagaatccttttacctct

SEQ ID NO: 1979 - RNA, 19 nt, synthetic construct
  misc_feature 1..19: note = siRNA Sense Sequence
  source 1..19: mol_type = other RNA
gtaaaaggattcttcagct

SEQ ID NO: 1980 - RNA, 19 nt, synthetic construct
  misc_feature 1..19: note = siRNA Antisense Sequence
  source 1..19: mol_type = other RNA
agctgaagaatccttttac

SEQ ID NO: 1981 - RNA, 19 nt, synthetic construct
  misc_feature 1..19: note = siRNA Sense Sequence
  source 1..19: mol_type = other RNA
taaaaggattcttcagctc

SEQ ID NO: 1982 - RNA, 19 nt, synthetic construct
  misc_feature 1..19: note = siRNA Antisense Sequence
  source 1..19: mol_type = other RNA
gagctgaagaatcctttta

SEQ ID NO: 1983 - RNA, 19 nt, synthetic construct
  misc_feature 1..19: note = siRNA Sense Sequence
  source 1..19: mol_type = other RNA
aaaaggattcttcagctct

SEQ ID NO: 1984 - RNA, 19 nt, synthetic construct
  misc_feature 1..19: note = siRNA Antisense Sequence
  source 1..19: mol_type = other RNA
agagctgaagaatcctttt

SEQ ID NO: 1985 - RNA, 19 nt, synthetic construct
  misc_feature 1..19: note = siRNA Sense Sequence
  source 1..19: mol_type = other RNA
aaaggattcttcagctctt

SEQ ID NO: 1986 - RNA, 19 nt, synthetic construct
  misc_feature 1..19: note = siRNA Antisense Sequence
  source 1..19: mol_type = other RNA
aagagctgaagaatccttt

SEQ ID NO: 1987 - RNA, 19 nt, synthetic construct
  misc_feature 1..19: note = siRNA Sense Sequence
  source 1..19: mol_type = other RNA
aaggattcttcagctcttt

SEQ ID NO: 1988 - RNA, 19 nt, synthetic construct
  misc_feature 1..19: note = siRNA Antisense Sequence
  source 1..19: mol_type = other RNA
aaagagctgaagaatcctt

SEQ ID NO: 1989 - RNA, 19 nt, synthetic construct
  misc_feature 1..19: note = siRNA Sense Sequence
  source 1..19: mol_type = other RNA
aggattcttcagctctttg

SEQ ID NO: 1990 - RNA, 19 nt, synthetic construct
  misc_feature 1..19: note = siRNA Antisense Sequence
  source 1..19: mol_type = other RNA
caaagagctgaagaatcct

SEQ ID NO: 1991 - RNA, 19 nt, synthetic construct
  misc_feature 1..19: note = siRNA Sense Sequence
  source 1..19: mol_type = other RNA
ggattcttcagctctttga

SEQ ID NO: 1992 - RNA, 19 nt, synthetic construct
  misc_feature 1..19: note = siRNA Antisense Sequence
  source 1..19: mol_type = other RNA
tcaaagagctgaagaatcc

SEQ ID NO: 1993 - RNA, 19 nt, synthetic construct
  misc_feature 1..19: note = siRNA Sense Sequence
  source 1..19: mol_type = other RNA
aaaatggttctcagctccg

SEQ ID NO: 1994 - RNA, 19 nt, synthetic construct
  misc_feature 1..19: note = siRNA Antisense Sequence
  source 1..19: mol_type = other RNA
cggagctgagaaccatttt

SEQ ID NO: 1995 - RNA, 19 nt, synthetic construct
  misc_feature 1..19: note = siRNA Sense Sequence
  source 1..19: mol_type = other RNA
aaatggttctcagctccgt

SEQ ID NO: 1996 - RNA, 19 nt, synthetic construct
  misc_feature 1..19: note = siRNA Antisense Sequence
  source 1..19: mol_type = other RNA
acggagctgagaaccattt

SEQ ID NO: 1997 - RNA, 19 nt, synthetic construct
  misc_feature 1..19: note = siRNA Sense Sequence
  source 1..19: mol_type = other RNA
ggttctcagctccgttgtg

SEQ ID NO: 1998 - RNA, 19 nt, synthetic construct
  misc_feature 1..19: note = siRNA Antisense Sequence
  source 1..19: mol_type = other RNA
cacaacggagctgagaacc

SEQ ID NO: 1999 - RNA, 19 nt, synthetic construct
  misc_feature 1..19: note = siRNA Sense Sequence
  source 1..19: mol_type = other RNA
gttctcagctccgttgtgt

SEQ ID NO: 2000 - RNA, 19 nt, synthetic construct
  misc_feature 1..19: note = siRNA Antisense Sequence
  source 1..19: mol_type = other RNA
acacaacggagctgagaac

SEQ ID NO: 2001 - RNA, 19 nt, synthetic construct
  misc_feature 1..19: note = siRNA Sense Sequence
  source 1..19: mol_type = other RNA
ttctcagctccgttgtgtc

SEQ ID NO: 2002 - RNA, 19 nt, synthetic construct
  misc_feature 1..19: note = siRNA Antisense Sequence
  source 1..19: mol_type = other RNA
gacacaacggagctgagaa

SEQ ID NO: 2003 - RNA, 19 nt, synthetic construct
  misc_feature 1..19: note = siRNA Sense Sequence
  source 1..19: mol_type = other RNA
tctcagctccgttgtgtcc

SEQ ID NO: 2004 - RNA, 19 nt, synthetic construct
  misc_feature 1..19: note = siRNA Antisense Sequence
  source 1..19: mol_type = other RNA
ggacacaacggagctgaga

SEQ ID NO: 2005 - RNA, 19 nt, synthetic construct
  misc_feature 1..19: note = siRNA Sense Sequence
  source 1..19: mol_type = other RNA
ctcagctccgttgtgtcca

SEQ ID NO: 2006 - RNA, 19 nt, synthetic construct
  misc_feature 1..19: note = siRNA Antisense Sequence
  source 1..19: mol_type = other RNA
tggacacaacggagctgag

SEQ ID NO: 2007 - RNA, 19 nt, synthetic construct
  misc_feature 1..19: note = siRNA Sense Sequence
  source 1..19: mol_type = other RNA
tcagctccgttgtgtccaa

SEQ ID NO: 2008 - RNA, 19 nt, synthetic construct
  misc_feature 1..19: note = siRNA Antisense Sequence
  source 1..19: mol_type = other RNA
ttggacacaacggagctga

SEQ ID NO: 2009 - RNA, 19 nt, synthetic construct
  misc_feature 1..19: note = siRNA Sense Sequence
  source 1..19: mol_type = other RNA
atcggttggatggataaga

SEQ ID NO: 2010 - RNA, 19 nt, synthetic construct
  misc_feature 1..19: note = siRNA Antisense Sequence
  source 1..19: mol_type = other RNA
tcttatccatccaaccgat

SEQ ID NO: 2011 - RNA, 19 nt, synthetic construct
  misc_feature 1..19: note = siRNA Sense Sequence
  source 1..19: mol_type = other RNA
tcggttggatggataagaa

SEQ ID NO: 2012 - RNA, 19 nt, synthetic construct
  misc_feature 1..19: note = siRNA Antisense Sequence
  source 1..19: mol_type = other RNA
ttcttatccatccaaccga

SEQ ID NO: 2013 - RNA, 19 nt, synthetic construct
  misc_feature 1..19: note = siRNA Sense Sequence
  source 1..19: mol_type = other RNA
cggttggatggataagaat

SEQ ID NO: 2014 - RNA, 19 nt, synthetic construct
  misc_feature 1..19: note = siRNA Antisense Sequence
  source 1..19: mol_type = other RNA
attcttatccatccaaccg

SEQ ID NO: 2015 - RNA, 19 nt, synthetic construct
  misc_feature 1..19: note = siRNA Sense Sequence
  source 1..19: mol_type = other RNA
ggttggatggataagaatt

SEQ ID NO: 2016 - RNA, 19 nt, synthetic construct
  misc_feature 1..19: note = siRNA Antisense Sequence
  source 1..19: mol_type = other RNA
aattcttatccatccaacc

SEQ ID NO: 2017 - RNA, 19 nt, synthetic construct
  misc_feature 1..19: note = siRNA Sense Sequence
  source 1..19: mol_type = other RNA
ggatggataagaattttga

SEQ ID NO: 2018 - RNA, 19 nt, synthetic construct
  misc_feature 1..19: note = siRNA Antisense Sequence
  source 1..19: mol_type = other RNA
tcaaaattcttatccatcc

SEQ ID NO: 2019 - RNA, 19 nt, synthetic construct
  misc_feature 1..19: note = siRNA Sense Sequence
  source 1..19: mol_type = other RNA
gataaaatcagagtgtggc

SEQ ID NO: 2020 - RNA, 19 nt, synthetic construct
  misc_feature 1..19: note = siRNA Antisense Sequence
  source 1..19: mol_type = other RNA
gccacactctgattttatc

SEQ ID NO: 2021 - RNA, 19 nt, synthetic construct
  misc_feature 1..19: note = siRNA Sense Sequence
  source 1..19: mol_type = other RNA
taaaatcagagtgtggctg

SEQ ID NO: 2022 - RNA, 19 nt, synthetic construct
  misc_feature 1..19: note = siRNA Antisense Sequence
  source 1..19: mol_type = other RNA
cagccacactctgatttta

SEQ ID NO: 2023 - RNA, 19 nt, synthetic construct
  misc_feature 1..19: note = siRNA Sense Sequence
  source 1..19: mol_type = other RNA
aaaatcagagtgtggctgc

SEQ ID NO: 2024 - RNA, 19 nt, synthetic construct
  misc_feature 1..19: note = siRNA Antisense Sequence
  source 1..19: mol_type = other RNA
gcagccacactctgatttt

SEQ ID NO: 2025 - RNA, 19 nt, synthetic construct
  misc_feature 1..19: note = siRNA Sense Sequence
  source 1..19: mol_type = other RNA
aaatcagagtgtggctgca

SEQ ID NO: 2026 - RNA, 19 nt, synthetic construct
  misc_feature 1..19: note = siRNA Antisense Sequence
  source 1..19: mol_type = other RNA
tgcagccacactctgattt

SEQ ID NO: 2027 - RNA, 19 nt, synthetic construct
  misc_feature 1..19: note = siRNA Sense Sequence
  source 1..19: mol_type = other RNA
aatcagagtgtggctgcaa

SEQ ID NO: 2028 - RNA, 19 nt, synthetic construct
  misc_feature 1..19: note = siRNA Antisense Sequence
  source 1..19: mol_type = other RNA
ttgcagccacactctgatt

SEQ ID NO: 2029 - RNA, 19 nt, synthetic construct
  misc_feature 1..19: note = siRNA Sense Sequence
  source 1..19: mol_type = other RNA
tcagagtgtggctgcaaag

SEQ ID NO: 2030 - RNA, 19 nt, synthetic construct
  misc_feature 1..19: note = siRNA Antisense Sequence
  source 1..19: mol_type = other RNA
ctttgcagccacactctga

SEQ ID NO: 2031 - RNA, 19 nt, synthetic construct
  misc_feature 1..19: note = siRNA Sense Sequence
  source 1..19: mol_type = other RNA
cagagtgtggctgcaaagt

SEQ ID NO: 2032 - RNA, 19 nt, synthetic construct
  misc_feature 1..19: note = siRNA Antisense Sequence
  source 1..19: mol_type = other RNA
actttgcagccacactctg

SEQ ID NO: 2033 - RNA, 19 nt, synthetic construct
  misc_feature 1..19: note = siRNA Sense Sequence
  source 1..19: mol_type = other RNA
agagtgtggctgcaaagtg

SEQ ID NO: 2034 - RNA, 19 nt, synthetic construct
  misc_feature 1..19: note = siRNA Antisense Sequence
  source 1..19: mol_type = other RNA
cactttgcagccacactct

SEQ ID NO: 2035 - RNA, 19 nt, synthetic construct
  misc_feature 1..19: note = siRNA Sense Sequence
  source 1..19: mol_type = other RNA
gagtgtggctgcaaagtga

SEQ ID NO: 2036 - RNA, 19 nt, synthetic construct
  misc_feature 1..19: note = siRNA Antisense Sequence
  source 1..19: mol_type = other RNA
tcactttgcagccacactc

SEQ ID NO: 2037 - RNA, 19 nt, synthetic construct
  misc_feature 1..19: note = siRNA Sense Sequence
  source 1..19: mol_type = other RNA
agtgtggctgcaaagtgaa

SEQ ID NO: 2038 - RNA, 19 nt, synthetic construct
  misc_feature 1..19: note = siRNA Antisense Sequence
  source 1..19: mol_type = other RNA
ttcactttgcagccacact

SEQ ID NO: 2039 - RNA, 19 nt, synthetic construct
  misc_feature 1..19: note = siRNA Sense Sequence
  source 1..19: mol_type = other RNA
acatgatcctgaagctgac

SEQ ID NO: 2040 - RNA, 19 nt, synthetic construct
  misc_feature 1..19: note = siRNA Antisense Sequence
  source 1..19: mol_type = other RNA
gtcagcttcaggatcatgt

SEQ ID NO: 2041 - RNA, 19 nt, synthetic construct
  misc_feature 1..19: note = siRNA Sense Sequence
  source 1..19: mol_type = other RNA
catgatcctgaagctgacg

SEQ ID NO: 2042 - RNA, 19 nt, synthetic construct
  misc_feature 1..19: note = siRNA Antisense Sequence
  source 1..19: mol_type = other RNA
cgtcagcttcaggatcatg

SEQ ID NO: 2043 - RNA, 19 nt, synthetic construct
  misc_feature 1..19: note = siRNA Sense Sequence
  source 1..19: mol_type = other RNA
atgatcctgaagctgacgc

SEQ ID NO: 2044 - RNA, 19 nt, synthetic construct
  misc_feature 1..19: note = siRNA Antisense Sequence
  source 1..19: mol_type = other RNA
gcgtcagcttcaggatcat

SEQ ID NO: 2045 - RNA, 19 nt, synthetic construct
  misc_feature 1..19: note = siRNA Sense Sequence
  source 1..19: mol_type = other RNA
tgatcctgaagctgacgca

SEQ ID NO: 2046 - RNA, 19 nt, synthetic construct
  misc_feature 1..19: note = siRNA Antisense Sequence
  source 1..19: mol_type = other RNA
tgcgtcagcttcaggatca

SEQ ID NO: 2047 - RNA, 19 nt, synthetic construct
  misc_feature 1..19: note = siRNA Sense Sequence
  source 1..19: mol_type = other RNA
gatcctgaagctgacgcaa

SEQ ID NO: 2048 - RNA, 19 nt, synthetic construct
  misc_feature 1..19: note = siRNA Antisense Sequence
  source 1..19: mol_type = other RNA
ttgcgtcagcttcaggatc

SEQ ID NO: 2049 - RNA, 19 nt, synthetic construct
  misc_feature 1..19: note = siRNA Sense Sequence
  source 1..19: mol_type = other RNA
atcctgaagctgacgcaac

SEQ ID NO: 2050 - RNA, 19 nt, synthetic construct
  misc_feature 1..19: note = siRNA Antisense Sequence
  source 1..19: mol_type = other RNA
gttgcgtcagcttcaggat

SEQ ID NO: 2051 - RNA, 19 nt, synthetic construct
  misc_feature 1..19: note = siRNA Sense Sequence
  source 1..19: mol_type = other RNA
aaaatccatcagaatctca

SEQ ID NO: 2052 - RNA, 19 nt, synthetic construct
  misc_feature 1..19: note = siRNA Antisense Sequence
  source 1..19: mol_type = other RNA
tgagattctgatggatttt

SEQ ID NO: 2053 - RNA, 19 nt, synthetic construct
  misc_feature 1..19: note = siRNA Sense Sequence
  source 1..19: mol_type = other RNA
cactaaatatgctttgatg

SEQ ID NO: 2054 - RNA, 19 nt, synthetic construct
  misc_feature 1..19: note = siRNA Antisense Sequence
  source 1..19: mol_type = other RNA
catcaaagcatatttagtg

SEQ ID NO: 2055 - RNA, 19 nt, synthetic construct
  misc_feature 1..19: note = siRNA Sense Sequence
  source 1..19: mol_type = other RNA
actaaatatgctttgatgc

SEQ ID NO: 2056 - RNA, 19 nt, synthetic construct
  misc_feature 1..19: note = siRNA Antisense Sequence
  source 1..19: mol_type = other RNA
gcatcaaagcatatttagt

SEQ ID NO: 2057 - RNA, 19 nt, synthetic construct
  misc_feature 1..19: note = siRNA Sense Sequence
  source 1..19: mol_type = other RNA
ctaaatatgctttgatgct

SEQ ID NO: 2058 - RNA, 19 nt, synthetic construct
  misc_feature 1..19: note = siRNA Antisense Sequence
  source 1..19: mol_type = other RNA
agcatcaaagcatatttag

SEQ ID NO: 2059 - RNA, 19 nt, synthetic construct
  misc_feature 1..19: note = siRNA Sense Sequence
  source 1..19: mol_type = other RNA
aaatatgctttgatgctac

SEQ ID NO: 2060 - RNA, 19 nt, synthetic construct
  misc_feature 1..19: note = siRNA Antisense Sequence
  source 1..19: mol_type = other RNA
gtagcatcaaagcatattt

SEQ ID NO: 2061 - RNA, 19 nt, synthetic construct
  misc_feature 1..19: note = siRNA Sense Sequence
  source 1..19: mol_type = other RNA
aatatgctttgatgctaca

SEQ ID NO: 2062 - RNA, 19 nt, synthetic construct
  misc_feature 1..19: note = siRNA Antisense Sequence
  source 1..19: mol_type = other RNA
tgtagcatcaaagcatatt

SEQ ID NO: 2063 - RNA, 19 nt, synthetic construct
  misc_feature 1..19: note = siRNA Sense Sequence
  source 1..19: mol_type = other RNA
cttcgctaaagttacttca

SEQ ID NO: 2064 - RNA, 19 nt, synthetic construct
  misc_feature 1..19: note = siRNA Antisense Sequence
  source 1..19: mol_type = other RNA
tgaagtaactttagcgaag

SEQ ID NO: 2065 - RNA, 19 nt, synthetic construct
  misc_feature 1..19: note = siRNA Sense Sequence
  source 1..19: mol_type = other RNA
ttcgctaaagttacttcat

SEQ ID NO: 2066 - RNA, 19 nt, synthetic construct
  misc_feature 1..19: note = siRNA Antisense Sequence
  source 1..19: mol_type = other RNA
atgaagtaactttagcgaa

SEQ ID NO: 2067 - RNA, 19 nt, synthetic construct
  misc_feature 1..19: note = siRNA Sense Sequence
  source 1..19: mol_type = other RNA
tcgctaaagttacttcatc

SEQ ID NO: 2068 - RNA, 19 nt, synthetic construct
  misc_feature 1..19: note = siRNA Antisense Sequence
  source 1..19: mol_type = other RNA
gatgaagtaactttagcga

SEQ ID NO: 2069 - RNA, 19 nt, synthetic construct
  misc_feature 1..19: note = siRNA Sense Sequence
  source 1..19: mol_type = other RNA
cgctaaagttacttcatct

SEQ ID NO: 2070 - RNA, 19 nt, synthetic construct
  misc_feature 1..19: note = siRNA Antisense Sequence
  source 1..19: mol_type = other RNA
agatgaagtaactttagcg

SEQ ID NO: 2071 - RNA, 19 nt, synthetic construct
  misc_feature 1..19: note = siRNA Sense Sequence
  source 1..19: mol_type = other RNA
tacttcatctccatctagc

SEQ ID NO: 2072 - RNA, 19 nt, synthetic construct
  misc_feature 1..19: note = siRNA Antisense Sequence
  source 1..19: mol_type = other RNA
gctagatggagatgaagta

SEQ ID NO: 2073 - RNA, 19 nt, synthetic construct
  misc_feature 1..19: note = siRNA Sense Sequence
  source 1..19: mol_type = other RNA
acttcatctccatctagca

SEQ ID NO: 2074 - RNA, 19 nt, synthetic construct
  misc_feature 1..19: note = siRNA Antisense Sequence
  source 1..19: mol_type = other RNA
tgctagatggagatgaagt

SEQ ID NO: 2075 - RNA, 19 nt, synthetic construct
  misc_feature 1..19: note = siRNA Sense Sequence
  source 1..19: mol_type = other RNA
cttcatctccatctagcaa

SEQ ID NO: 2076 - RNA, 19 nt, synthetic construct
  misc_feature 1..19: note = siRNA Antisense Sequence
  source 1..19: mol_type = other RNA
ttgctagatggagatgaag

SEQ ID NO: 2077 - RNA, 19 nt, synthetic construct
  misc_feature 1..19: note = siRNA Sense Sequence
  source 1..19: mol_type = other RNA
ttcatctccatctagcaaa

SEQ ID NO: 2078 - RNA, 19 nt, synthetic construct
  misc_feature 1..19: note = siRNA Antisense Sequence
  source 1..19: mol_type = other RNA
tttgctagatggagatgaa

SEQ ID NO: 2079 - RNA, 19 nt, synthetic construct
  misc_feature 1..19: note = siRNA Sense Sequence
  source 1..19: mol_type = other RNA
tcatctccatctagcaaat

SEQ ID NO: 2080 - RNA, 19 nt, synthetic construct
  misc_feature 1..19: note = siRNA Antisense Sequence
  source 1..19: mol_type = other RNA
atttgctagatggagatga

SEQ ID NO: 2081 - RNA, 19 nt, synthetic construct
  misc_feature 1..19: note = siRNA Sense Sequence
  source 1..19: mol_type = other RNA
catctccatctagcaaatg

SEQ ID NO: 2082 - RNA, 19 nt, synthetic construct
  misc_feature 1..19: note = siRNA Antisense Sequence
  source 1..19: mol_type = other RNA
catttgctagatggagatg

SEQ ID NO: 2083 - RNA, 19 nt, synthetic construct
  misc_feature 1..19: note = siRNA Sense Sequence
  source 1..19: mol_type = other RNA
tccatctagcaaatgaggc

SEQ ID NO: 2084 - RNA, 19 nt, synthetic construct
  misc_feature 1..19: note = siRNA Antisense Sequence
  source 1..19: mol_type = other RNA
gcctcatttgctagatgga

SEQ ID NO: 2085 - RNA, 19 nt, synthetic construct
  misc_feature 1..19: note = siRNA Sense Sequence
  source 1..19: mol_type = other RNA
ccatctagcaaatgaggca

SEQ ID NO: 2086 - RNA, 19 nt, synthetic construct
  misc_feature 1..19: note = siRNA Antisense Sequence
  source 1..19: mol_type = other RNA
tgcctcatttgctagatgg

SEQ ID NO: 2087 - RNA, 19 nt, synthetic construct
  misc_feature 1..19: note = siRNA Sense Sequence
  source 1..19: mol_type = other RNA
catctagcaaatgaggcac

SEQ ID NO: 2088 - RNA, 19 nt, synthetic construct
  misc_feature 1..19: note = siRNA Antisense Sequence
  source 1..19: mol_type = other RNA
gtgcctcatttgctagatg

SEQ ID NO: 2089 - RNA, 19 nt, synthetic construct
  misc_feature 1..19: note = siRNA Sense Sequence
  source 1..19: mol_type = other RNA
ggcactgttctcaaccaaa

SEQ ID NO: 2090 - RNA, 19 nt, synthetic construct
  misc_feature 1..19: note = siRNA Antisense Sequence
  source 1..19: mol_type = other RNA
tttggttgagaacagtgcc

SEQ ID NO: 2091 - RNA, 19 nt, synthetic construct
  misc_feature 1..19: note = siRNA Sense Sequence
  source 1..19: mol_type = other RNA
ctgttctcaaccaaaggag

SEQ ID NO: 2092 - RNA, 19 nt, synthetic construct
  misc_feature 1..19: note = siRNA Antisense Sequence
  source 1..19: mol_type = other RNA
ctcctttggttgagaacag

SEQ ID NO: 2093 - RNA, 19 nt, synthetic construct
  misc_feature 1..19: note = siRNA Sense Sequence
  source 1..19: mol_type = other RNA
ccctttataatttgatgtg

SEQ ID NO: 2094 - RNA, 19 nt, synthetic construct
  misc_feature 1..19: note = siRNA Antisense Sequence
  source 1..19: mol_type = other RNA
cacatcaaattataaaggg

SEQ ID NO: 2095 - RNA, 19 nt, synthetic construct
  misc_feature 1..19: note = siRNA Sense Sequence
  source 1..19: mol_type = other RNA
cctttataatttgatgtgc

SEQ ID NO: 2096 - RNA, 19 nt, synthetic construct
  misc_feature 1..19: note = siRNA Antisense Sequence
  source 1..19: mol_type = other RNA
gcacatcaaattataaagg

SEQ ID NO: 2097 - RNA, 19 nt, synthetic construct
  misc_feature 1..19: note = siRNA Sense Sequence
  source 1..19: mol_type = other RNA
ataatttgatgtgctgtgg

SEQ ID NO: 2098 - RNA, 19 nt, synthetic construct
  misc_feature 1..19: note = siRNA Antisense Sequence
  source 1..19: mol_type = other RNA
ccacagcacatcaaattat

SEQ ID NO: 2099 - RNA, 19 nt, synthetic construct
  misc_feature 1..19: note = siRNA Sense Sequence
  source 1..19: mol_type = other RNA
tttgatgtgctgtggtctc

SEQ ID NO: 2100 - RNA, 19 nt, synthetic construct
  misc_feature 1..19: note = siRNA Antisense Sequence
  source 1..19: mol_type = other RNA
gagaccacagcacatcaaa

SEQ ID NO: 2101 - RNA, 19 nt, synthetic construct
  misc_feature 1..19: note = siRNA Sense Sequence
  source 1..19: mol_type = other RNA
atgtgctgtggtctccttg

SEQ ID NO: 2102 - RNA, 19 nt, synthetic construct
  misc_feature 1..19: note = siRNA Antisense Sequence
  source 1..19: mol_type = other RNA
caaggagaccacagcacat

SEQ ID NO: 2103 - RNA, 19 nt, synthetic construct
  misc_feature 1..19: note = siRNA Sense Sequence
  source 1..19: mol_type = other RNA
tgtgctgtggtctccttgg

SEQ ID NO: 2104 - RNA, 19 nt, synthetic construct
  misc_feature 1..19: note = siRNA Antisense Sequence
  source 1..19: mol_type = other RNA
ccaaggagaccacagcaca

SEQ ID NO: 2105 - RNA, 19 nt, synthetic construct
  misc_feature 1..19: note = siRNA Sense Sequence
  source 1..19: mol_type = other RNA
gtgctgtggtctccttggt

SEQ ID NO: 2106 - RNA, 19 nt, synthetic construct
  misc_feature 1..19: note = siRNA Antisense Sequence
  source 1..19: mol_type = other RNA
accaaggagaccacagcac

SEQ ID NO: 2107 - RNA, 19 nt, synthetic construct
  misc_feature 1..19: note = siRNA Sense Sequence
  source 1..19: mol_type = other RNA
tgctgtggtctccttggta

SEQ ID NO: 2108 - RNA, 19 nt, synthetic construct
  misc_feature 1..19: note = siRNA Antisense Sequence
  source 1..19: mol_type = other RNA
taccaaggagaccacagca

SEQ ID NO: 2109 - RNA, 19 nt, synthetic construct
  misc_feature 1..19: note = siRNA Sense Sequence
  source 1..19: mol_type = other RNA
gctgtggtctccttggtaa

SEQ ID NO: 2110 - RNA, 19 nt, synthetic construct
  misc_feature 1..19: note = siRNA Antisense Sequence
  source 1..19: mol_type = other RNA
ttaccaaggagaccacagc

SEQ ID NO: 2111 - RNA, 19 nt, synthetic construct
  misc_feature 1..19: note = siRNA Sense Sequence
  source 1..19: mol_type = other RNA
ctgtggtctccttggtaat

SEQ ID NO: 2112 - RNA, 19 nt, synthetic construct
  misc_feature 1..19: note = siRNA Antisense Sequence
  source 1..19: mol_type = other RNA
attaccaaggagaccacag

SEQ ID NO: 2113 - RNA, 19 nt, synthetic construct
  misc_feature 1..19: note = siRNA Sense Sequence
  source 1..19: mol_type = other RNA
tgtggtctccttggtaatg

SEQ ID NO: 2114 - RNA, 19 nt, synthetic construct
  misc_feature 1..19: note = siRNA Antisense Sequence
  source 1..19: mol_type = other RNA
cattaccaaggagaccaca

SEQ ID NO: 2115 - RNA, 19 nt, synthetic construct
  misc_feature 1..19: note = siRNA Sense Sequence
  source 1..19: mol_type = other RNA
taatttggtattgcacagg

SEQ ID NO: 2116 - RNA, 19 nt, synthetic construct
  misc_feature 1..19: note = siRNA Antisense Sequence
  source 1..19: mol_type = other RNA
cctgtgcaataccaaatta

SEQ ID NO: 2117 - RNA, 19 nt, synthetic construct
  misc_feature 1..19: note = siRNA Sense Sequence
  source 1..19: mol_type = other RNA
aatttggtattgcacaggt

SEQ ID NO: 2118 - RNA, 19 nt, synthetic construct
  misc_feature 1..19: note = siRNA Antisense Sequence
  source 1..19: mol_type = other RNA
acctgtgcaataccaaatt

SEQ ID NO: 2119 - RNA, 19 nt, synthetic construct
  misc_feature 1..19: note = siRNA Sense Sequence
  source 1..19: mol_type = other RNA
atttggtattgcacaggtg

SEQ ID NO: 2120 - RNA, 19 nt, synthetic construct
  misc_feature 1..19: note = siRNA Antisense Sequence
  source 1..19: mol_type = other RNA
cacctgtgcaataccaaat

SEQ ID NO: 2121 - RNA, 19 nt, synthetic construct
  misc_feature 1..19: note = siRNA Sense Sequence
  source 1..19: mol_type = other RNA
tttggtattgcacaggtga

SEQ ID NO: 2122 - RNA, 19 nt, synthetic construct
  misc_feature 1..19: note = siRNA Antisense Sequence
  source 1..19: mol_type = other RNA
tcacctgtgcaataccaaa

SEQ ID NO: 2123 - RNA, 19 nt, synthetic construct
  misc_feature 1..19: note = siRNA Sense Sequence
  source 1..19: mol_type = other RNA
ttggtattgcacaggtgat

SEQ ID NO: 2124 - RNA, 19 nt, synthetic construct
  misc_feature 1..19: note = siRNA Antisense Sequence
  source 1..19: mol_type = other RNA
atcacctgtgcaataccaa

SEQ ID NO: 2125 - RNA, 19 nt, synthetic construct
  misc_feature 1..19: note = siRNA Sense Sequence
  source 1..19: mol_type = other RNA
tggtattgcacaggtgatt

SEQ ID NO: 2126 - RNA, 19 nt, synthetic construct
  misc_feature 1..19: note = siRNA Antisense Sequence
  source 1..19: mol_type = other RNA
aatcacctgtgcaatacca

SEQ ID NO: 2127 - RNA, 19 nt, synthetic construct
  misc_feature 1..19: note = siRNA Sense Sequence
  source 1..19: mol_type = other RNA
ggtattgcacaggtgatta

SEQ ID NO: 2128 - RNA, 19 nt, synthetic construct
  misc_feature 1..19: note = siRNA Antisense Sequence
  source 1..19: mol_type = other RNA
taatcacctgtgcaatacc

SEQ ID NO: 2129 - RNA, 19 nt, synthetic construct
  misc_feature 1..19: note = siRNA Sense Sequence
  source 1..19: mol_type = other RNA
gtattgcacaggtgattag

SEQ ID NO: 2130 - RNA, 19 nt, synthetic construct
  misc_feature 1..19: note = siRNA Antisense Sequence
  source 1..19: mol_type = other RNA
ctaatcacctgtgcaatac

SEQ ID NO: 2131 - RNA, 19 nt, synthetic construct
  misc_feature 1..19: note = siRNA Sense Sequence
  source 1..19: mol_type = other RNA
tattgcacaggtgattagt

SEQ ID NO: 2132 - RNA, 19 nt, synthetic construct
  misc_feature 1..19: note = siRNA Antisense Sequence
  source 1..19: mol_type = other RNA
actaatcacctgtgcaata

SEQ ID NO: 2133 - RNA, 19 nt, synthetic construct
  misc_feature 1..19: note = siRNA Sense Sequence
  source 1..19: mol_type = other RNA
attgcacaggtgattagtc

SEQ ID NO: 2134 - RNA, 19 nt, synthetic construct
  misc_feature 1..19: note = siRNA Antisense Sequence
  source 1..19: mol_type = other RNA
gactaatcacctgtgcaat

SEQ ID NO: 2135 - RNA, 19 nt, synthetic construct
  misc_feature 1..19: note = siRNA Sense Sequence
  source 1..19: mol_type = other RNA
ttgcacaggtgattagtca

SEQ ID NO: 2136 - RNA, 19 nt, synthetic construct
  misc_feature 1..19: note = siRNA Antisense Sequence
  source 1..19: mol_type = other RNA
tgactaatcacctgtgcaa

SEQ ID NO: 2137 - RNA, 19 nt, synthetic construct
  misc_feature 1..19: note = siRNA Sense Sequence
  source 1..19: mol_type = other RNA
tgcacaggtgattagtcaa

SEQ ID NO: 2138 - RNA, 19 nt, synthetic construct
  misc_feature 1..19: note = siRNA Antisense Sequence
  source 1..19: mol_type = other RNA
ttgactaatcacctgtgca

SEQ ID NO: 2139 - RNA, 19 nt, synthetic construct
  misc_feature 1..19: note = siRNA Sense Sequence
  source 1..19: mol_type = other RNA
gcacaggtgattagtcaag

SEQ ID NO: 2140 - RNA, 19 nt, synthetic construct
  misc_feature 1..19: note = siRNA Antisense Sequence
  source 1..19: mol_type = other RNA
cttgactaatcacctgtgc

SEQ ID NO: 2141 - RNA, 19 nt, synthetic construct
  misc_feature 1..19: note = siRNA Sense Sequence
  source 1..19: mol_type = other RNA
cacaggtgattagtcaagg

SEQ ID NO: 2142 - RNA, 19 nt, synthetic construct
  misc_feature 1..19: note = siRNA Antisense Sequence
  source 1..19: mol_type = other RNA
ccttgactaatcacctgtg

SEQ ID NO: 2143 - RNA, 19 nt, synthetic construct
  misc_feature 1..19: note = siRNA Sense Sequence
  source 1..19: mol_type = other RNA
acaggtgattagtcaagga

SEQ ID NO: 2144 - RNA, 19 nt, synthetic construct
  misc_feature 1..19: note = siRNA Antisense Sequence
  source 1..19: mol_type = other RNA
tccttgactaatcacctgt

SEQ ID NO: 2145 - RNA, 19 nt, synthetic construct
  misc_feature 1..19: note = siRNA Sense Sequence
  source 1..19: mol_type = other RNA
caggtgattagtcaaggaa

SEQ ID NO: 2146 - RNA, 19 nt, synthetic construct
  misc_feature 1..19: note = siRNA Antisense Sequence
  source 1..19: mol_type = other RNA
ttccttgactaatcacctg

SEQ ID NO: 2147 - RNA, 19 nt, synthetic construct
  misc_feature 1..19: note = siRNA Sense Sequence
  source 1..19: mol_type = other RNA
aggtgattagtcaaggaag

SEQ ID NO: 2148 - RNA, 19 nt, synthetic construct
  misc_feature 1..19: note = siRNA Antisense Sequence
  source 1..19: mol_type = other RNA
cttccttgactaatcacct

SEQ ID NO: 2149 - RNA, 19 nt, synthetic construct
  misc_feature 1..19: note = siRNA Sense Sequence
  source 1..19: mol_type = other RNA
ggtgattagtcaaggaagt

SEQ ID NO: 2150 - RNA, 19 nt, synthetic construct
  misc_feature 1..19: note = siRNA Antisense Sequence
  source 1..19: mol_type = other RNA
acttccttgactaatcacc

SEQ ID NO: 2151 - RNA, 19 nt, synthetic construct
  misc_feature 1..19: note = siRNA Sense Sequence
  source 1..19: mol_type = other RNA
gtgattagtcaaggaagtc

SEQ ID NO: 2152 - RNA, 19 nt, synthetic construct
  misc_feature 1..19: note = siRNA Antisense Sequence
  source 1..19: mol_type = other RNA
gacttccttgactaatcac

SEQ ID NO: 2153 - RNA, 19 nt, synthetic construct
  misc_feature 1..19: note = siRNA Sense Sequence
  source 1..19: mol_type = other RNA
tgattagtcaaggaagtct

SEQ ID NO: 2154 - RNA, 19 nt, synthetic construct
  misc_feature 1..19: note = siRNA Antisense Sequence
  source 1..19: mol_type = other RNA
agacttccttgactaatca

SEQ ID NO: 2155 - RNA, 19 nt, synthetic construct
  misc_feature 1..19: note = siRNA Sense Sequence
  source 1..19: mol_type = other RNA
gattagtcaaggaagtctg

SEQ ID NO: 2156 - RNA, 19 nt, synthetic construct
  misc_feature 1..19: note = siRNA Antisense Sequence
  source 1..19: mol_type = other RNA
cagacttccttgactaatc

SEQ ID NO: 2157 - RNA, 19 nt, synthetic construct
  misc_feature 1..19: note = siRNA Sense Sequence
  source 1..19: mol_type = other RNA
ttagtcaaggaagtctgga

SEQ ID NO: 2158 - RNA, 19 nt, synthetic construct
  misc_feature 1..19: note = siRNA Antisense Sequence
  source 1..19: mol_type = other RNA
tccagacttccttgactaa

SEQ ID NO: 2159 - RNA, 19 nt, synthetic construct
  misc_feature 1..19: note = siRNA Sense Sequence
  source 1..19: mol_type = other RNA
tagtcaaggaagtctggaa

SEQ ID NO: 2160 - RNA, 19 nt, synthetic construct
  misc_feature 1..19: note = siRNA Antisense Sequence
  source 1..19: mol_type = other RNA
ttccagacttccttgacta

SEQ ID NO: 2161 - RNA, 19 nt, synthetic construct
  misc_feature 1..19: note = siRNA Sense Sequence
  source 1..19: mol_type = other RNA
cccacagccttgcctcaca

SEQ ID NO: 2162 - RNA, 19 nt, synthetic construct
  misc_feature 1..19: note = siRNA Antisense Sequence
  source 1..19: mol_type = other RNA
tgtgaggcaaggctgtggg

SEQ ID NO: 2163 - RNA, 19 nt, synthetic construct
  misc_feature 1..19: note = siRNA Sense Sequence
  source 1..19: mol_type = other RNA
ccacagccttgcctcacag

SEQ ID NO: 2164 - RNA, 19 nt, synthetic construct
  misc_feature 1..19: note = siRNA Antisense Sequence
  source 1..19: mol_type = other RNA
ctgtgaggcaaggctgtgg

SEQ ID NO: 2165 - RNA, 19 nt, synthetic construct
  misc_feature 1..19: note = siRNA Sense Sequence
  source 1..19: mol_type = other RNA
cacagccttgcctcacagc

SEQ ID NO: 2166 - RNA, 19 nt, synthetic construct
  misc_feature 1..19: note = siRNA Antisense Sequence
  source 1..19: mol_type = other RNA
gctgtgaggcaaggctgtg

SEQ ID NO: 2167 - RNA, 19 nt, synthetic construct
  misc_feature 1..19: note = siRNA Sense Sequence
  source 1..19: mol_type = other RNA
acagccttgcctcacagca

SEQ ID NO: 2168 - RNA, 19 nt, synthetic construct
  misc_feature 1..19: note = siRNA Antisense Sequence
  source 1..19: mol_type = other RNA
tgctgtgaggcaaggctgt

SEQ ID NO: 2169 - RNA, 19 nt, synthetic construct
  misc_feature 1..19: note = siRNA Sense Sequence
  source 1..19: mol_type = other RNA
cagccttgcctcacagcat

SEQ ID NO: 2170 - RNA, 19 nt, synthetic construct
  misc_feature 1..19: note = siRNA Antisense Sequence
  source 1..19: mol_type = other RNA
atgctgtgaggcaaggctg

SEQ ID NO: 2171 - RNA, 19 nt, synthetic construct
  misc_feature 1..19: note = siRNA Sense Sequence
  source 1..19: mol_type = other RNA
agccttgcctcacagcatg

SEQ ID NO: 2172 - RNA, 19 nt, synthetic construct
  misc_feature 1..19: note = siRNA Antisense Sequence
  source 1..19: mol_type = other RNA
catgctgtgaggcaaggct

SEQ ID NO: 2173 - RNA, 19 nt, synthetic construct
  misc_feature 1..19: note = siRNA Sense Sequence
  source 1..19: mol_type = other RNA
gccttgcctcacagcatgt

SEQ ID NO: 2174 - RNA, 19 nt, synthetic construct
  misc_feature 1..19: note = siRNA Antisense Sequence
  source 1..19: mol_type = other RNA
acatgctgtgaggcaaggc

SEQ ID NO: 2175 - RNA, 19 nt, synthetic construct
  misc_feature 1..19: note = siRNA Sense Sequence
  source 1..19: mol_type = other RNA
ccttgcctcacagcatgta

SEQ ID NO: 2176 - RNA, 19 nt, synthetic construct
  misc_feature 1..19: note = siRNA Antisense Sequence
  source 1..19: mol_type = other RNA
tacatgctgtgaggcaagg

SEQ ID NO: 2177 - RNA, 19 nt, synthetic construct
  misc_feature 1..19: note = siRNA Sense Sequence
  source 1..19: mol_type = other RNA
cttgcctcacagcatgtaa

SEQ ID NO: 2178 - RNA, 19 nt, synthetic construct
  misc_feature 1..19: note = siRNA Antisense Sequence
  source 1..19: mol_type = other RNA
ttacatgctgtgaggcaag

SEQ ID NO: 2179 - RNA, 19 nt, synthetic construct
  misc_feature 1..19: note = siRNA Sense Sequence
  source 1..19: mol_type = other RNA
ttgcctcacagcatgtaaa

SEQ ID NO: 2180 - RNA, 19 nt, synthetic construct
  misc_feature 1..19: note = siRNA Antisense Sequence
  source 1..19: mol_type = other RNA
tttacatgctgtgaggcaa

SEQ ID NO: 2181 - RNA, 19 nt, synthetic construct
  misc_feature 1..19: note = siRNA Sense Sequence
  source 1..19: mol_type = other RNA
tgcctcacagcatgtaaat

SEQ ID NO: 2182 - RNA, 19 nt, synthetic construct
  misc_feature 1..19: note = siRNA Antisense Sequence
  source 1..19: mol_type = other RNA
atttacatgctgtgaggca

SEQ ID NO: 2183 - RNA, 19 nt, synthetic construct
  misc_feature 1..19: note = siRNA Sense Sequence
  source 1..19: mol_type = other RNA
gcctcacagcatgtaaata

SEQ ID NO: 2184 - RNA, 19 nt, synthetic construct
  misc_feature 1..19: note = siRNA Antisense Sequence
  source 1..19: mol_type = other RNA
tatttacatgctgtgaggc

SEQ ID NO: 2185 - RNA, 19 nt, synthetic construct
  misc_feature 1..19: note = siRNA Sense Sequence
  source 1..19: mol_type = other RNA
cctcacagcatgtaaataa

SEQ ID NO: 2186 - RNA, 19 nt, synthetic construct
  misc_feature 1..19: note = siRNA Antisense Sequence
  source 1..19: mol_type = other RNA
ttatttacatgctgtgagg

SEQ ID NO: 2187 - RNA, 19 nt, synthetic construct
  misc_feature 1..19: note = siRNA Sense Sequence
  source 1..19: mol_type = other RNA
caatattgatgctgaggtt

SEQ ID NO: 2188 - RNA, 19 nt, synthetic construct
  misc_feature 1..19: note = siRNA Antisense Sequence
  source 1..19: mol_type = other RNA
aacctcagcatcaatattg

SEQ ID NO: 2189 - RNA, 19 nt, synthetic construct
  misc_feature 1..19: note = siRNA Sense Sequence
  source 1..19: mol_type = other RNA
aatattgatgctgaggttc

SEQ ID NO: 2190 - RNA, 19 nt, synthetic construct
  misc_feature 1..19: note = siRNA Antisense Sequence
  source 1..19: mol_type = other RNA
gaacctcagcatcaatatt

SEQ ID NO: 2191 - RNA, 19 nt, synthetic construct
  misc_feature 1..19: note = siRNA Sense Sequence
  source 1..19: mol_type = other RNA
atattgatgctgaggttct

SEQ ID NO: 2192 - RNA, 19 nt, synthetic construct
  misc_feature 1..19: note = siRNA Antisense Sequence
  source 1..19: mol_type = other RNA
agaacctcagcatcaatat

SEQ ID NO: 2193 - RNA, 19 nt, synthetic construct
  misc_feature 1..19: note = siRNA Sense Sequence
  source 1..19: mol_type = other RNA
tattgatgctgaggttctt

SEQ ID NO: 2194 - RNA, 19 nt, synthetic construct
  misc_feature 1..19: note = siRNA Antisense Sequence
  source 1..19: mol_type = other RNA
aagaacctcagcatcaata

SEQ ID NO: 2195 - RNA, 19 nt, synthetic construct
  misc_feature 1..19: note = siRNA Sense Sequence
  source 1..19: mol_type = other RNA
attgatgctgaggttcttc

SEQ ID NO: 2196 - RNA, 19 nt, synthetic construct
  misc_feature 1..19: note = siRNA Antisense Sequence
  source 1..19: mol_type = other RNA
gaagaacctcagcatcaat

SEQ ID NO: 2197 - RNA, 19 nt, synthetic construct
  misc_feature 1..19: note = siRNA Sense Sequence
  source 1..19: mol_type = other RNA
ttgatgctgaggttcttct

SEQ ID NO: 2198 - RNA, 19 nt, synthetic construct
  misc_feature 1..19: note = siRNA Antisense Sequence
  source 1..19: mol_type = other RNA
agaagaacctcagcatcaa

SEQ ID NO: 2199 - RNA, 19 nt, synthetic construct
  misc_feature 1..19: note = siRNA Sense Sequence
  source 1..19: mol_type = other RNA
tgatgctgaggttcttcta

SEQ ID NO: 2200 - RNA, 19 nt, synthetic construct
  misc_feature 1..19: note = siRNA Antisense Sequence
  source 1..19: mol_type = other RNA
tagaagaacctcagcatca

SEQ ID NO: 2201 - RNA, 19 nt, synthetic construct
  misc_feature 1..19: note = siRNA Sense Sequence
  source 1..19: mol_type = other RNA
gaggttcttctactgctag

SEQ ID NO: 2202 - RNA, 19 nt, synthetic construct
  misc_feature 1..19: note = siRNA Antisense Sequence
  source 1..19: mol_type = other RNA
ctagcagtagaagaacctc

SEQ ID NO: 2203 - RNA, 19 nt, synthetic construct
  misc_feature 1..19: note = siRNA Sense Sequence
  source 1..19: mol_type = other RNA
aggttcttctactgctagt

SEQ ID NO: 2204 - RNA, 19 nt, synthetic construct
  misc_feature 1..19: note = siRNA Antisense Sequence
  source 1..19: mol_type = other RNA
actagcagtagaagaacct

SEQ ID NO: 2205 - RNA, 19 nt, synthetic construct
  misc_feature 1..19: note = siRNA Sense Sequence
  source 1..19: mol_type = other RNA
ttttactggtgtgaattgg

SEQ ID NO: 2206 - RNA, 19 nt, synthetic construct
  misc_feature 1..19: note = siRNA Antisense Sequence
  source 1..19: mol_type = other RNA
ccaattcacaccagtaaaa

SEQ ID NO: 2207 - RNA, 19 nt, synthetic construct
  misc_feature 1..19: note = siRNA Sense Sequence
  source 1..19: mol_type = other RNA
tttactggtgtgaattggg

SEQ ID NO: 2208 - RNA, 19 nt, synthetic construct
  misc_feature 1..19: note = siRNA Antisense Sequence
  source 1..19: mol_type = other RNA
cccaattcacaccagtaaa

SEQ ID NO: 2209 - RNA, 19 nt, synthetic construct
  misc_feature 1..19: note = siRNA Sense Sequence
  source 1..19: mol_type = other RNA
ttactggtgtgaattggga

SEQ ID NO: 2210 - RNA, 19 nt, synthetic construct
  misc_feature 1..19: note = siRNA Antisense Sequence
  source 1..19: mol_type = other RNA
tcccaattcacaccagtaa

SEQ ID NO: 2211 - RNA, 19 nt, synthetic construct
  misc_feature 1..19: note = siRNA Sense Sequence
  source 1..19: mol_type = other RNA
tactggtgtgaattgggaa

SEQ ID NO: 2212 - RNA, 19 nt, synthetic construct
  misc_feature 1..19: note = siRNA Antisense Sequence
  source 1..19: mol_type = other RNA
ttcccaattcacaccagta

SEQ ID NO: 2213 - RNA, 19 nt, synthetic construct
  misc_feature 1..19: note = siRNA Sense Sequence
  source 1..19: mol_type = other RNA
ctggtgtgaattgggaaga

SEQ ID NO: 2214 - RNA, 19 nt, synthetic construct
  misc_feature 1..19: note = siRNA Antisense Sequence
  source 1..19: mol_type = other RNA
tcttcccaattcacaccag

SEQ ID NO: 2215 - RNA, 19 nt, synthetic construct
  misc_feature 1..19: note = siRNA Sense Sequence
  source 1..19: mol_type = other RNA
tggtgtgaattgggaagaa

SEQ ID NO: 2216 - RNA, 19 nt, synthetic construct
  misc_feature 1..19: note = siRNA Antisense Sequence
  source 1..19: mol_type = other RNA
ttcttcccaattcacacca

SEQ ID NO: 2217 - RNA, 19 nt, synthetic construct
  misc_feature 1..19: note = siRNA Sense Sequence
  source 1..19: mol_type = other RNA
tgctattccatgacgtttg

SEQ ID NO: 2218 - RNA, 19 nt, synthetic construct
  misc_feature 1..19: note = siRNA Antisense Sequence
  source 1..19: mol_type = other RNA
caaacgtcatggaatagca

SEQ ID NO: 2219 - RNA, 19 nt, synthetic construct
  misc_feature 1..19: note = siRNA Sense Sequence
  source 1..19: mol_type = other RNA
gctattccatgacgtttgt

SEQ ID NO: 2220 - RNA, 19 nt, synthetic construct
  misc_feature 1..19: note = siRNA Antisense Sequence
  source 1..19: mol_type = other RNA
acaaacgtcatggaatagc

SEQ ID NO: 2221 - RNA, 19 nt, synthetic construct
  misc_feature 1..19: note = siRNA Sense Sequence
  source 1..19: mol_type = other RNA
ctattccatgacgtttgta

SEQ ID NO: 2222 - RNA, 19 nt, synthetic construct
  misc_feature 1..19: note = siRNA Antisense Sequence
  source 1..19: mol_type = other RNA
tacaaacgtcatggaatag

SEQ ID NO: 2223 - RNA, 19 nt, synthetic construct
  misc_feature 1..19: note = siRNA Sense Sequence
  source 1..19: mol_type = other RNA
tattccatgacgtttgtaa

SEQ ID NO: 2224 - RNA, 19 nt, synthetic construct
  misc_feature 1..19: note = siRNA Antisense Sequence
  source 1..19: mol_type = other RNA
ttacaaacgtcatggaata

SEQ ID NO: 2225 - RNA, 19 nt, synthetic construct
  misc_feature 1..19: note = siRNA Sense Sequence
  source 1..19: mol_type = other RNA
attccatgacgtttgtaaa

SEQ ID NO: 2226 - RNA, 19 nt, synthetic construct
  misc_feature 1..19: note = siRNA Antisense Sequence
  source 1..19: mol_type = other RNA
tttacaaacgtcatggaat

SEQ ID NO: 2227 - RNA, 19 nt, synthetic construct
  misc_feature 1..19: note = siRNA Sense Sequence
  source 1..19: mol_type = other RNA
ttccatgacgtttgtaaaa

SEQ ID NO: 2228 - RNA, 19 nt, synthetic construct
  misc_feature 1..19: note = siRNA Antisense Sequence
  source 1..19: mol_type = other RNA
ttttacaaacgtcatggaa

SEQ ID NO: 2229 - RNA, 19 nt, synthetic construct
  misc_feature 1..19: note = siRNA Sense Sequence
  source 1..19: mol_type = other RNA
tccatgacgtttgtaaaat

SEQ ID NO: 2230 - RNA, 19 nt, synthetic construct
  misc_feature 1..19: note = siRNA Antisense Sequence
  source 1..19: mol_type = other RNA
attttacaaacgtcatgga

SEQ ID NO: 2231 - RNA, 19 nt, synthetic construct
  misc_feature 1..19: note = siRNA Sense Sequence
  source 1..19: mol_type = other RNA
ccatgacgtttgtaaaatg

SEQ ID NO: 2232 - RNA, 19 nt, synthetic construct
  misc_feature 1..19: note = siRNA Antisense Sequence
  source 1..19: mol_type = other RNA
cattttacaaacgtcatgg

SEQ ID NO: 2233 - RNA, 19 nt, synthetic construct
  misc_feature 1..19: note = siRNA Sense Sequence
  source 1..19: mol_type = other RNA
catgacgtttgtaaaatgt

SEQ ID NO: 2234 - RNA, 19 nt, synthetic construct
  misc_feature 1..19: note = siRNA Antisense Sequence
  source 1..19: mol_type = other RNA
acattttacaaacgtcatg

SEQ ID NO: 2235 - RNA, 19 nt, synthetic construct
  misc_feature 1..19: note = siRNA Sense Sequence
  source 1..19: mol_type = other RNA
cttgaggttaaataatggg

SEQ ID NO: 2236 - RNA, 19 nt, synthetic construct
  misc_feature 1..19: note = siRNA Antisense Sequence
  source 1..19: mol_type = other RNA
cccattatttaacctcaag

SEQ ID NO: 2237 - RNA, 19 nt, synthetic construct
  misc_feature 1..19: note = siRNA Sense Sequence
  source 1..19: mol_type = other RNA
ttgaggttaaataatgggt

SEQ ID NO: 2238 - RNA, 19 nt, synthetic construct
  misc_feature 1..19: note = siRNA Antisense Sequence
  source 1..19: mol_type = other RNA
acccattatttaacctcaa

SEQ ID NO: 2239 - RNA, 19 nt, synthetic construct
  misc_feature 1..19: note = siRNA Sense Sequence
  source 1..19: mol_type = other RNA
tgaggttaaataatgggta

SEQ ID NO: 2240 - RNA, 19 nt, synthetic construct
  misc_feature 1..19: note = siRNA Antisense Sequence
  source 1..19: mol_type = other RNA
tacccattatttaacctca

SEQ ID NO: 2241 - RNA, 19 nt, synthetic construct
  misc_feature 1..19: note = siRNA Sense Sequence
  source 1..19: mol_type = other RNA
gaggttaaataatgggtag

SEQ ID NO: 2242 - RNA, 19 nt, synthetic construct
  misc_feature 1..19: note = siRNA Antisense Sequence
  source 1..19: mol_type = other RNA
ctacccattatttaacctc

SEQ ID NO: 2243 - RNA, 19 nt, synthetic construct
  misc_feature 1..19: note = siRNA Sense Sequence
  source 1..19: mol_type = other RNA
aggttaaataatgggtagt

SEQ ID NO: 2244 - RNA, 19 nt, synthetic construct
  misc_feature 1..19: note = siRNA Antisense Sequence
  source 1..19: mol_type = other RNA
actacccattatttaacct

SEQ ID NO: 2245 - RNA, 19 nt, synthetic construct
  misc_feature 1..19: note = siRNA Sense Sequence
  source 1..19: mol_type = other RNA
ggttaaataatgggtagta

SEQ ID NO: 2246 - RNA, 19 nt, synthetic construct
  misc_feature 1..19: note = siRNA Antisense Sequence
  source 1..19: mol_type = other RNA
tactacccattatttaacc

SEQ ID NO: 2247 - RNA, 19 nt, synthetic construct
  misc_feature 1..19: note = siRNA Sense Sequence
  source 1..19: mol_type = other RNA
taatattaaggtccttgac

SEQ ID NO: 2248 - RNA, 19 nt, synthetic construct
  misc_feature 1..19: note = siRNA Antisense Sequence
  source 1..19: mol_type = other RNA
gtcaaggaccttaatatta

SEQ ID NO: 2249 - RNA, 19 nt, synthetic construct
  misc_feature 1..19: note = siRNA Sense Sequence
  source 1..19: mol_type = other RNA
aatattaaggtccttgact

SEQ ID NO: 2250 - RNA, 19 nt, synthetic construct
  misc_feature 1..19: note = siRNA Antisense Sequence
  source 1..19: mol_type = other RNA
agtcaaggaccttaatatt

SEQ ID NO: 2251 - RNA, 19 nt, synthetic construct
  misc_feature 1..19: note = siRNA Sense Sequence
  source 1..19: mol_type = other RNA
atattaaggtccttgacta

SEQ ID NO: 2252 - RNA, 19 nt, synthetic construct
  misc_feature 1..19: note = siRNA Antisense Sequence
  source 1..19: mol_type = other RNA
tagtcaaggaccttaatat

SEQ ID NO: 2253 - RNA, 19 nt, synthetic construct
  misc_feature 1..19: note = siRNA Sense Sequence
  source 1..19: mol_type = other RNA
tattaaggtccttgactat

SEQ ID NO: 2254 - RNA, 19 nt, synthetic construct
  misc_feature 1..19: note = siRNA Antisense Sequence
  source 1..19: mol_type = other RNA
atagtcaaggaccttaata

SEQ ID NO: 2255 - RNA, 19 nt, synthetic construct
  misc_feature 1..19: note = siRNA Sense Sequence
  source 1..19: mol_type = other RNA
attaaggtccttgactatg

SEQ ID NO: 2256 - RNA, 19 nt, synthetic construct
  misc_feature 1..19: note = siRNA Antisense Sequence
  source 1..19: mol_type = other RNA
catagtcaaggaccttaat

SEQ ID NO: 2257 - RNA, 19 nt, synthetic construct
  misc_feature 1..19: note = siRNA Sense Sequence
  source 1..19: mol_type = other RNA
aggtccttgactatgtgta

SEQ ID NO: 2258 - RNA, 19 nt, synthetic construct
  misc_feature 1..19: note = siRNA Antisense Sequence
  source 1..19: mol_type = other RNA
tacacatagtcaaggacct

SEQ ID NO: 2259 - RNA, 19 nt, synthetic construct
  misc_feature 1..19: note = siRNA Sense Sequence
  source 1..19: mol_type = other RNA
ggtccttgactatgtgtac

SEQ ID NO: 2260 - RNA, 19 nt, synthetic construct
  misc_feature 1..19: note = siRNA Antisense Sequence
  source 1..19: mol_type = other RNA
gtacacatagtcaaggacc

SEQ ID NO: 2261 - RNA, 19 nt, synthetic construct
  misc_feature 1..19: note = siRNA Sense Sequence
  source 1..19: mol_type = other RNA
taatctctgccatctcgct

SEQ ID NO: 2262 - RNA, 19 nt, synthetic construct
  misc_feature 1..19: note = siRNA Antisense Sequence
  source 1..19: mol_type = other RNA
agcgagatggcagagatta

SEQ ID NO: 2263 - RNA, 19 nt, synthetic construct
  misc_feature 1..19: note = siRNA Sense Sequence
  source 1..19: mol_type = other RNA
atctctgccatctcgctaa

SEQ ID NO: 2264 - RNA, 19 nt, synthetic construct
  misc_feature 1..19: note = siRNA Antisense Sequence
  source 1..19: mol_type = other RNA
ttagcgagatggcagagat

SEQ ID NO: 2265 - RNA, 19 nt, synthetic construct
  misc_feature 1..19: note = siRNA Sense Sequence
  source 1..19: mol_type = other RNA
tctctgccatctcgctaaa

SEQ ID NO: 2266 - RNA, 19 nt, synthetic construct
  misc_feature 1..19: note = siRNA Antisense Sequence
  source 1..19: mol_type = other RNA
tttagcgagatggcagaga

SEQ ID NO: 2267 - RNA, 19 nt, synthetic construct
  misc_feature 1..19: note = siRNA Sense Sequence
  source 1..19: mol_type = other RNA
ctctgccatctcgctaaat

SEQ ID NO: 2268 - RNA, 19 nt, synthetic construct
  misc_feature 1..19: note = siRNA Antisense Sequence
  source 1..19: mol_type = other RNA
atttagcgagatggcagag

SEQ ID NO: 2269 - RNA, 19 nt, synthetic construct
  misc_feature 1..19: note = siRNA Sense Sequence
  source 1..19: mol_type = other RNA
tctgccatctcgctaaatc

SEQ ID NO: 2270 - RNA, 19 nt, synthetic construct
  misc_feature 1..19: note = siRNA Antisense Sequence
  source 1..19: mol_type = other RNA
gatttagcgagatggcaga

SEQ ID NO: 2271 - RNA, 19 nt, synthetic construct
  misc_feature 1..19: note = siRNA Sense Sequence
  source 1..19: mol_type = other RNA
ctgccatctcgctaaatca

SEQ ID NO: 2272 - RNA, 19 nt, synthetic construct
  misc_feature 1..19: note = siRNA Antisense Sequence
  source 1..19: mol_type = other RNA
tgatttagcgagatggcag

SEQ ID NO: 2273 - RNA, 19 nt, synthetic construct
  misc_feature 1..19: note = siRNA Sense Sequence
  source 1..19: mol_type = other RNA
tgccatctcgctaaatcat

SEQ ID NO: 2274 - RNA, 19 nt, synthetic construct
  misc_feature 1..19: note = siRNA Antisense Sequence
  source 1..19: mol_type = other RNA
atgatttagcgagatggca

SEQ ID NO: 2275 - RNA, 19 nt, synthetic construct
  misc_feature 1..19: note = siRNA Sense Sequence
  source 1..19: mol_type = other RNA
gccatctcgctaaatcatc

SEQ ID NO: 2276 - RNA, 19 nt, synthetic construct
  misc_feature 1..19: note = siRNA Antisense Sequence
  source 1..19: mol_type = other RNA
gatgatttagcgagatggc

SEQ ID NO: 2277 - RNA, 19 nt, synthetic construct
  misc_feature 1..19: note = siRNA Sense Sequence
  source 1..19: mol_type = other RNA
ccatctcgctaaatcatca

SEQ ID NO: 2278 - RNA, 19 nt, synthetic construct
  misc_feature 1..19: note = siRNA Antisense Sequence
  source 1..19: mol_type = other RNA
tgatgatttagcgagatgg

SEQ ID NO: 2279 - RNA, 19 nt, synthetic construct
  misc_feature 1..19: note = siRNA Sense Sequence
  source 1..19: mol_type = other RNA
aggtgcctgatcttcctaa

SEQ ID NO: 2280 - RNA, 19 nt, synthetic construct
  misc_feature 1..19: note = siRNA Antisense Sequence
  source 1..19: mol_type = other RNA
ttaggaagatcaggcacct

SEQ ID NO: 2281 - RNA, 19 nt, synthetic construct
  misc_feature 1..19: note = siRNA Sense Sequence
  source 1..19: mol_type = other RNA
ggtgcctgatcttcctaat

SEQ ID NO: 2282 - RNA, 19 nt, synthetic construct
  misc_feature 1..19: note = siRNA Antisense Sequence
  source 1..19: mol_type = other RNA
attaggaagatcaggcacc

SEQ ID NO: 2283 - RNA, 19 nt, synthetic construct
  misc_feature 1..19: note = siRNA Sense Sequence
  source 1..19: mol_type = other RNA
gtgcctgatcttcctaata

SEQ ID NO: 2284 - RNA, 19 nt, synthetic construct
  misc_feature 1..19: note = siRNA Antisense Sequence
  source 1..19: mol_type = other RNA
tattaggaagatcaggcac

SEQ ID NO: 2285 - RNA, 19 nt, synthetic construct
  misc_feature 1..19: note = siRNA Sense Sequence
  source 1..19: mol_type = other RNA
tgcctgatcttcctaataa

SEQ ID NO: 2286 - RNA, 19 nt, synthetic construct
  misc_feature 1..19: note = siRNA Antisense Sequence
  source 1..19: mol_type = other RNA
ttattaggaagatcaggca

SEQ ID NO: 2287 - RNA, 19 nt, synthetic construct
  misc_feature 1..19: note = siRNA Sense Sequence
  source 1..19: mol_type = other RNA
gatcttcctaataattctg

SEQ ID NO: 2288 - RNA, 19 nt, synthetic construct
  misc_feature 1..19: note = siRNA Antisense Sequence
  source 1..19: mol_type = other RNA
cagaattattaggaagatc

SEQ ID NO: 2289 - RNA, 19 nt, synthetic construct
  misc_feature 1..19: note = siRNA Sense Sequence
  source 1..19: mol_type = other RNA
atcttcctaataattctgc

SEQ ID NO: 2290 - RNA, 19 nt, synthetic construct
  misc_feature 1..19: note = siRNA Antisense Sequence
  source 1..19: mol_type = other RNA
gcagaattattaggaagat

SEQ ID NO: 2291 - RNA, 19 nt, synthetic construct
  misc_feature 1..19: note = siRNA Sense Sequence
  source 1..19: mol_type = other RNA
tcttcctaataattctgcc

SEQ ID NO: 2292 - RNA, 19 nt, synthetic construct
  misc_feature 1..19: note = siRNA Antisense Sequence
  source 1..19: mol_type = other RNA
ggcagaattattaggaaga

SEQ ID NO: 2293 - RNA, 19 nt, synthetic construct
  misc_feature 1..19: note = siRNA Sense Sequence
  source 1..19: mol_type = other RNA
cttcctaataattctgcct

SEQ ID NO: 2294 - RNA, 19 nt, synthetic construct
  misc_feature 1..19: note = siRNA Antisense Sequence
  source 1..19: mol_type = other RNA
aggcagaattattaggaag

SEQ ID NO: 2295 - RNA, 19 nt, synthetic construct
  misc_feature 1..19: note = siRNA Sense Sequence
  source 1..19: mol_type = other RNA
ttcctaataattctgccta

SEQ ID NO: 2296 - RNA, 19 nt, synthetic construct
  misc_feature 1..19: note = siRNA Antisense Sequence
  source 1..19: mol_type = other RNA
taggcagaattattaggaa

SEQ ID NO: 2297 - RNA, 19 nt, synthetic construct
  misc_feature 1..19: note = siRNA Sense Sequence
  source 1..19: mol_type = other RNA
tcctaataattctgcctat

SEQ ID NO: 2298 - RNA, 19 nt, synthetic construct
  misc_feature 1..19: note = siRNA Antisense Sequence
  source 1..19: mol_type = other RNA
ataggcagaattattagga

SEQ ID NO: 2299 - RNA, 19 nt, synthetic construct
  misc_feature 1..19: note = siRNA Sense Sequence
  source 1..19: mol_type = other RNA
ttctgcctattttcatttg

SEQ ID NO: 2300 - RNA, 19 nt, synthetic construct
  misc_feature 1..19: note = siRNA Antisense Sequence
  source 1..19: mol_type = other RNA
caaatgaaaataggcagaa

SEQ ID NO: 2301 - RNA, 19 nt, synthetic construct
  misc_feature 1..19: note = siRNA Sense Sequence
  source 1..19: mol_type = other RNA
tctgcctattttcatttgc

SEQ ID NO: 2302 - RNA, 19 nt, synthetic construct
  misc_feature 1..19: note = siRNA Antisense Sequence
  source 1..19: mol_type = other RNA
gcaaatgaaaataggcaga

SEQ ID NO: 2303 - RNA, 19 nt, synthetic construct
  misc_feature 1..19: note = siRNA Sense Sequence
  source 1..19: mol_type = other RNA
gcctattttcatttgcttt

SEQ ID NO: 2304 - RNA, 19 nt, synthetic construct
  misc_feature 1..19: note = siRNA Antisense Sequence
  source 1..19: mol_type = other RNA
aaagcaaatgaaaataggc

SEQ ID NO: 2305 - RNA, 19 nt, synthetic construct
  misc_feature 1..19: note = siRNA Sense Sequence
  source 1..19: mol_type = other RNA
attttctttctagttgtgg

SEQ ID NO: 2306 - RNA, 19 nt, synthetic construct
  misc_feature 1..19: note = siRNA Antisense Sequence
  source 1..19: mol_type = other RNA
ccacaactagaaagaaaat

SEQ ID NO: 2307 - RNA, 19 nt, synthetic construct
  misc_feature 1..19: note = siRNA Sense Sequence
  source 1..19: mol_type = other RNA
ttttctttctagttgtggc

SEQ ID NO: 2308 - RNA, 19 nt, synthetic construct
  misc_feature 1..19: note = siRNA Antisense Sequence
  source 1..19: mol_type = other RNA
gccacaactagaaagaaaa

SEQ ID NO: 2309 - RNA, 19 nt, synthetic construct
  misc_feature 1..19: note = siRNA Sense Sequence
  source 1..19: mol_type = other RNA
ttctttctagttgtggctg

SEQ ID NO: 2310 - RNA, 19 nt, synthetic construct
  misc_feature 1..19: note = siRNA Antisense Sequence
  source 1..19: mol_type = other RNA
cagccacaactagaaagaa

SEQ ID NO: 2311 - RNA, 19 nt, synthetic construct
  misc_feature 1..19: note = siRNA Sense Sequence
  source 1..19: mol_type = other RNA
tctcccaaataagatgtgc

SEQ ID NO: 2312 - RNA, 19 nt, synthetic construct
  misc_feature 1..19: note = siRNA Antisense Sequence
  source 1..19: mol_type = other RNA
gcacatcttatttgggaga

SEQ ID NO: 2313 - RNA, 19 nt, synthetic construct
  misc_feature 1..19: note = siRNA Sense Sequence
  source 1..19: mol_type = other RNA
ctcccaaataagatgtgct

SEQ ID NO: 2314 - RNA, 19 nt, synthetic construct
  misc_feature 1..19: note = siRNA Antisense Sequence
  source 1..19: mol_type = other RNA
agcacatcttatttgggag

SEQ ID NO: 2315 - RNA, 19 nt, synthetic construct
  misc_feature 1..19: note = siRNA Sense Sequence
  source 1..19: mol_type = other RNA
aagatgtgctgcttaccga

SEQ ID NO: 2316 - RNA, 19 nt, synthetic construct
  misc_feature 1..19: note = siRNA Antisense Sequence
  source 1..19: mol_type = other RNA
tcggtaagcagcacatctt

SEQ ID NO: 2317 - RNA, 19 nt, synthetic construct
  misc_feature 1..19: note = siRNA Sense Sequence
  source 1..19: mol_type = other RNA
agatgtgctgcttaccgag

SEQ ID NO: 2318 - RNA, 19 nt, synthetic construct
  misc_feature 1..19: note = siRNA Antisense Sequence
  source 1..19: mol_type = other RNA
ctcggtaagcagcacatct

SEQ ID NO: 2319 - RNA, 19 nt, synthetic construct
  misc_feature 1..19: note = siRNA Sense Sequence
  source 1..19: mol_type = other RNA
gatgtgctgcttaccgagg

SEQ ID NO: 2320 - RNA, 19 nt, synthetic construct
  misc_feature 1..19: note = siRNA Antisense Sequence
  source 1..19: mol_type = other RNA
cctcggtaagcagcacatc

SEQ ID NO: 2321 - RNA, 19 nt, synthetic construct
  misc_feature 1..19: note = siRNA Sense Sequence
  source 1..19: mol_type = other RNA
atgtgctgcttaccgaggt

SEQ ID NO: 2322 - RNA, 19 nt, synthetic construct
  misc_feature 1..19: note = siRNA Antisense Sequence
  source 1..19: mol_type = other RNA
acctcggtaagcagcacat

SEQ ID NO: 2323 - RNA, 19 nt, synthetic construct
  misc_feature 1..19: note = siRNA Sense Sequence
  source 1..19: mol_type = other RNA
tgtgctgcttaccgaggta

SEQ ID NO: 2324 - RNA, 19 nt, synthetic construct
  misc_feature 1..19: note = siRNA Antisense Sequence
  source 1..19: mol_type = other RNA
tacctcggtaagcagcaca

SEQ ID NO: 2325 - RNA, 19 nt, synthetic construct
  misc_feature 1..19: note = siRNA Sense Sequence
  source 1..19: mol_type = other RNA
ctgcttaccgaggtatcac

SEQ ID NO: 2326 - RNA, 19 nt, synthetic construct
  misc_feature 1..19: note = siRNA Antisense Sequence
  source 1..19: mol_type = other RNA
gtgatacctcggtaagcag

SEQ ID NO: 2327 - RNA, 19 nt, synthetic construct
  misc_feature 1..19: note = siRNA Sense Sequence
  source 1..19: mol_type = other RNA
tgcttaccgaggtatcacg

SEQ ID NO: 2328 - RNA, 19 nt, synthetic construct
  misc_feature 1..19: note = siRNA Antisense Sequence
  source 1..19: mol_type = other RNA
cgtgatacctcggtaagca

SEQ ID NO: 2329 - RNA, 19 nt, synthetic construct
  misc_feature 1..19: note = siRNA Sense Sequence
  source 1..19: mol_type = other RNA
gcttaccgaggtatcacgg

SEQ ID NO: 2330 - RNA, 19 nt, synthetic construct
  misc_feature 1..19: note = siRNA Antisense Sequence
  source 1..19: mol_type = other RNA
ccgtgatacctcggtaagc

SEQ ID NO: 2331 - RNA, 19 nt, synthetic construct
  misc_feature 1..19: note = siRNA Sense Sequence
  source 1..19: mol_type = other RNA
cttaccgaggtatcacggg

SEQ ID NO: 2332 - RNA, 19 nt, synthetic construct
  misc_feature 1..19: note = siRNA Antisense Sequence
  source 1..19: mol_type = other RNA
cccgtgatacctcggtaag

SEQ ID NO: 2333 - RNA, 19 nt, synthetic construct
  misc_feature 1..19: note = siRNA Sense Sequence
  source 1..19: mol_type = other RNA
ggctccagcttgggtcgtt

SEQ ID NO: 2334 - RNA, 19 nt, synthetic construct
  misc_feature 1..19: note = siRNA Antisense Sequence
  source 1..19: mol_type = other RNA
aacgacccaagctggagcc

SEQ ID NO: 2335 - RNA, 19 nt, synthetic construct
  misc_feature 1..19: note = siRNA Sense Sequence
  source 1..19: mol_type = other RNA
gctccagcttgggtcgttg

SEQ ID NO: 2336 - RNA, 19 nt, synthetic construct
  misc_feature 1..19: note = siRNA Antisense Sequence
  source 1..19: mol_type = other RNA
caacgacccaagctggagc

SEQ ID NO: 2337 - RNA, 19 nt, synthetic construct
  misc_feature 1..19: note = siRNA Sense Sequence
  source 1..19: mol_type = other RNA
ctccagcttgggtcgttga

SEQ ID NO: 2338 - RNA, 19 nt, synthetic construct
  misc_feature 1..19: note = siRNA Antisense Sequence
  source 1..19: mol_type = other RNA
tcaacgacccaagctggag

SEQ ID NO: 2339 - RNA, 19 nt, synthetic construct
  misc_feature 1..19: note = siRNA Sense Sequence
  source 1..19: mol_type = other RNA
tccagcttgggtcgttgaa

SEQ ID NO: 2340 - RNA, 19 nt, synthetic construct
  misc_feature 1..19: note = siRNA Antisense Sequence
  source 1..19: mol_type = other RNA
ttcaacgacccaagctgga

SEQ ID NO: 2341 - RNA, 19 nt, synthetic construct
  misc_feature 1..19: note = siRNA Sense Sequence
  source 1..19: mol_type = other RNA
ccagcttgggtcgttgaag

SEQ ID NO: 2342 - RNA, 19 nt, synthetic construct
  misc_feature 1..19: note = siRNA Antisense Sequence
  source 1..19: mol_type = other RNA
cttcaacgacccaagctgg

SEQ ID NO: 2343 - RNA, 19 nt, synthetic construct
  misc_feature 1..19: note = siRNA Sense Sequence
  source 1..19: mol_type = other RNA
cttgggtcgttgaagctgg

SEQ ID NO: 2344 - RNA, 19 nt, synthetic construct
  misc_feature 1..19: note = siRNA Antisense Sequence
  source 1..19: mol_type = other RNA
ccagcttcaacgacccaag

SEQ ID NO: 2345 - RNA, 19 nt, synthetic construct
  misc_feature 1..19: note = siRNA Sense Sequence
  source 1..19: mol_type = other RNA
ttgggtcgttgaagctggg

SEQ ID NO: 2346 - RNA, 19 nt, synthetic construct
  misc_feature 1..19: note = siRNA Antisense Sequence
  source 1..19: mol_type = other RNA
cccagcttcaacgacccaa

SEQ ID NO: 2347 - RNA, 19 nt, synthetic construct
  misc_feature 1..19: note = siRNA Sense Sequence
  source 1..19: mol_type = other RNA
cagcaagtttagcatcttc

SEQ ID NO: 2348 - RNA, 19 nt, synthetic construct
  misc_feature 1..19: note = siRNA Antisense Sequence
  source 1..19: mol_type = other RNA
gaagatgctaaacttgctg

SEQ ID NO: 2349 - RNA, 19 nt, synthetic construct
  misc_feature 1..19: note = siRNA Sense Sequence
  source 1..19: mol_type = other RNA
caatgccatcacttaacta

SEQ ID NO: 2350 - RNA, 19 nt, synthetic construct
  misc_feature 1..19: note = siRNA Antisense Sequence
  source 1..19: mol_type = other RNA
tagttaagtgatggcattg

SEQ ID NO: 2351 - RNA, 19 nt, synthetic construct
  misc_feature 1..19: note = siRNA Sense Sequence
  source 1..19: mol_type = other RNA
atgccatcacttaactata

SEQ ID NO: 2352 - RNA, 19 nt, synthetic construct
  misc_feature 1..19: note = siRNA Antisense Sequence
  source 1..19: mol_type = other RNA
tatagttaagtgatggcat

SEQ ID NO: 2353 - RNA, 19 nt, synthetic construct
  misc_feature 1..19: note = siRNA Sense Sequence
  source 1..19: mol_type = other RNA
tgccatcacttaactataa

SEQ ID NO: 2354 - RNA, 19 nt, synthetic construct
  misc_feature 1..19: note = siRNA Antisense Sequence
  source 1..19: mol_type = other RNA
ttatagttaagtgatggca

SEQ ID NO: 2355 - RNA, 19 nt, synthetic construct
  misc_feature 1..19: note = siRNA Sense Sequence
  source 1..19: mol_type = other RNA
gccatcacttaactataac

SEQ ID NO: 2356 - RNA, 19 nt, synthetic construct
  misc_feature 1..19: note = siRNA Antisense Sequence
  source 1..19: mol_type = other RNA
gttatagttaagtgatggc

SEQ ID NO: 2357 - RNA, 19 nt, synthetic construct
  misc_feature 1..19: note = siRNA Sense Sequence
  source 1..19: mol_type = other RNA
ccatcacttaactataact

SEQ ID NO: 2358 - RNA, 19 nt, synthetic construct
  misc_feature 1..19: note = siRNA Antisense Sequence
  source 1..19: mol_type = other RNA
agttatagttaagtgatgg

SEQ ID NO: 2359 - RNA, 19 nt, synthetic construct
  misc_feature 1..19: note = siRNA Sense Sequence
  source 1..19: mol_type = other RNA
catcacttaactataactc

SEQ ID NO: 2360 - RNA, 19 nt, synthetic construct
  misc_feature 1..19: note = siRNA Antisense Sequence
  source 1..19: mol_type = other RNA
gagttatagttaagtgatg

SEQ ID NO: 2361 - RNA, 19 nt, synthetic construct
  misc_feature 1..19: note = siRNA Sense Sequence
  source 1..19: mol_type = other RNA
tctcttgaccaaatagact

SEQ ID NO: 2362 - RNA, 19 nt, synthetic construct
  misc_feature 1..19: note = siRNA Antisense Sequence
  source 1..19: mol_type = other RNA
agtctatttggtcaagaga

SEQ ID NO: 2363 - RNA, 19 nt, synthetic construct
  misc_feature 1..19: note = siRNA Sense Sequence
  source 1..19: mol_type = other RNA
ctcttgaccaaatagactc

SEQ ID NO: 2364 - RNA, 19 nt, synthetic construct
  misc_feature 1..19: note = siRNA Antisense Sequence
  source 1..19: mol_type = other RNA
gagtctatttggtcaagag

SEQ ID NO: 2365 - RNA, 19 nt, synthetic construct
  misc_feature 1..19: note = siRNA Sense Sequence
  source 1..19: mol_type = other RNA
tcttgaccaaatagactca

SEQ ID NO: 2366 - RNA, 19 nt, synthetic construct
  misc_feature 1..19: note = siRNA Antisense Sequence
  source 1..19: mol_type = other RNA
tgagtctatttggtcaaga

SEQ ID NO: 2367 - RNA, 19 nt, synthetic construct
  misc_feature 1..19: note = siRNA Sense Sequence
  source 1..19: mol_type = other RNA
cttgaccaaatagactcat

SEQ ID NO: 2368 - RNA, 19 nt, synthetic construct
  misc_feature 1..19: note = siRNA Antisense Sequence
  source 1..19: mol_type = other RNA
atgagtctatttggtcaag

SEQ ID NO: 2369 - RNA, 19 nt, synthetic construct
  misc_feature 1..19: note = siRNA Sense Sequence
  source 1..19: mol_type = other RNA
ttgaccaaatagactcata

SEQ ID NO: 2370 - RNA, 19 nt, synthetic construct
  misc_feature 1..19: note = siRNA Antisense Sequence
  source 1..19: mol_type = other RNA
tatgagtctatttggtcaa

SEQ ID NO: 2371 - RNA, 19 nt, synthetic construct
  misc_feature 1..19: note = siRNA Sense Sequence
  source 1..19: mol_type = other RNA
gaccaaatagactcataat

SEQ ID NO: 2372 - RNA, 19 nt, synthetic construct
  misc_feature 1..19: note = siRNA Antisense Sequence
  source 1..19: mol_type = other RNA
attatgagtctatttggtc

SEQ ID NO: 2373 - RNA, 19 nt, synthetic construct
  misc_feature 1..19: note = siRNA Sense Sequence
  source 1..19: mol_type = other RNA
tttcctgttgtacatttag

SEQ ID NO: 2374 - RNA, 19 nt, synthetic construct
  misc_feature 1..19: note = siRNA Antisense Sequence
  source 1..19: mol_type = other RNA
ctaaatgtacaacaggaaa

SEQ ID NO: 2375 - RNA, 19 nt, synthetic construct
  misc_feature 1..19: note = siRNA Sense Sequence
  source 1..19: mol_type = other RNA
ggttattcaaagttttcag

SEQ ID NO: 2376 - RNA, 19 nt, synthetic construct
  misc_feature 1..19: note = siRNA Antisense Sequence
  source 1..19: mol_type = other RNA
ctgaaaactttgaataacc

SEQ ID NO: 2377 - RNA, 19 nt, synthetic construct
  misc_feature 1..19: note = siRNA Sense Sequence
  source 1..19: mol_type = other RNA
tattcaaagttttcagctc

SEQ ID NO: 2378 - RNA, 19 nt, synthetic construct
  misc_feature 1..19: note = siRNA Antisense Sequence
  source 1..19: mol_type = other RNA
gagctgaaaactttgaata

SEQ ID NO: 2379 - RNA, 19 nt, synthetic construct
  misc_feature 1..19: note = siRNA Sense Sequence
  source 1..19: mol_type = other RNA
attcaaagttttcagctct

SEQ ID NO: 2380 - RNA, 19 nt, synthetic construct
  misc_feature 1..19: note = siRNA Antisense Sequence
  source 1..19: mol_type = other RNA
agagctgaaaactttgaat

SEQ ID NO: 2381 - RNA, 19 nt, synthetic construct
  misc_feature 1..19: note = siRNA Sense Sequence
  source 1..19: mol_type = other RNA
tcagctcttttaaaattgc

SEQ ID NO: 2382 - RNA, 19 nt, synthetic construct
  misc_feature 1..19: note = siRNA Antisense Sequence
  source 1..19: mol_type = other RNA
gcaattttaaaagagctga

SEQ ID NO: 2383 - RNA, 19 nt, synthetic construct
  misc_feature 1..19: note = siRNA Sense Sequence
  source 1..19: mol_type = other RNA
cagctcttttaaaattgct

SEQ ID NO: 2384 - RNA, 19 nt, synthetic construct
  misc_feature 1..19: note = siRNA Antisense Sequence
  source 1..19: mol_type = other RNA
agcaattttaaaagagctg

SEQ ID NO: 2385 - RNA, 19 nt, synthetic construct
  misc_feature 1..19: note = siRNA Sense Sequence
  source 1..19: mol_type = other RNA
agctcttttaaaattgctc

SEQ ID NO: 2386 - RNA, 19 nt, synthetic construct
  misc_feature 1..19: note = siRNA Antisense Sequence
  source 1..19: mol_type = other RNA
gagcaattttaaaagagct

SEQ ID NO: 2387 - RNA, 19 nt, synthetic construct
  misc_feature 1..19: note = siRNA Sense Sequence
  source 1..19: mol_type = other RNA
gctcttttaaaattgctct

SEQ ID NO: 2388 - RNA, 19 nt, synthetic construct
  misc_feature 1..19: note = siRNA Antisense Sequence
  source 1..19: mol_type = other RNA
agagcaattttaaaagagc

SEQ ID NO: 2389 - RNA, 19 nt, synthetic construct
  misc_feature 1..19: note = siRNA Sense Sequence
  source 1..19: mol_type = other RNA
aattgctctgaataagttc

SEQ ID NO: 2390 - RNA, 19 nt, synthetic construct
  misc_feature 1..19: note = siRNA Antisense Sequence
  source 1..19: mol_type = other RNA
gaacttattcagagcaatt

SEQ ID NO: 2391 - RNA, 19 nt, synthetic construct
  misc_feature 1..19: note = siRNA Sense Sequence
  source 1..19: mol_type = other RNA
attgctctgaataagttct

SEQ ID NO: 2392 - RNA, 19 nt, synthetic construct
  misc_feature 1..19: note = siRNA Antisense Sequence
  source 1..19: mol_type = other RNA
agaacttattcagagcaat

SEQ ID NO: 2393 - RNA, 19 nt, synthetic construct
  misc_feature 1..19: note = siRNA Sense Sequence
  source 1..19: mol_type = other RNA
ttgctctgaataagttcta

SEQ ID NO: 2394 - RNA, 19 nt, synthetic construct
  misc_feature 1..19: note = siRNA Antisense Sequence
  source 1..19: mol_type = other RNA
tagaacttattcagagcaa

SEQ ID NO: 2395 - RNA, 19 nt, synthetic construct
  misc_feature 1..19: note = siRNA Sense Sequence
  source 1..19: mol_type = other RNA
tgctctgaataagttctag

SEQ ID NO: 2396 - RNA, 19 nt, synthetic construct
  misc_feature 1..19: note = siRNA Antisense Sequence
  source 1..19: mol_type = other RNA
ctagaacttattcagagca

SEQ ID NO: 2397 - RNA, 19 nt, synthetic construct
  misc_feature 1..19: note = siRNA Sense Sequence
  source 1..19: mol_type = other RNA
ctgaataagttctagtgag

SEQ ID NO: 2398 - RNA, 19 nt, synthetic construct
  misc_feature 1..19: note = siRNA Antisense Sequence
  source 1..19: mol_type = other RNA
ctcactagaacttattcag

SEQ ID NO: 2399 - RNA, 19 nt, synthetic construct
  misc_feature 1..19: note = siRNA Sense Sequence
  source 1..19: mol_type = other RNA
ataagttctagtgagtgag

SEQ ID NO: 2400 - RNA, 19 nt, synthetic construct
  misc_feature 1..19: note = siRNA Antisense Sequence
  source 1..19: mol_type = other RNA
ctcactcactagaacttat

SEQ ID NO: 2401 - RNA, 19 nt, synthetic construct
  misc_feature 1..19: note = siRNA Sense Sequence
  source 1..19: mol_type = other RNA
ttctagtgagtgagttatg

SEQ ID NO: 2402 - RNA, 19 nt, synthetic construct
  misc_feature 1..19: note = siRNA Antisense Sequence
  source 1..19: mol_type = other RNA
cataactcactcactagaa

SEQ ID NO: 2403 - RNA, 19 nt, synthetic construct
  misc_feature 1..19: note = siRNA Sense Sequence
  source 1..19: mol_type = other RNA
tctagtgagtgagttatgg

SEQ ID NO: 2404 - RNA, 19 nt, synthetic construct
  misc_feature 1..19: note = siRNA Antisense Sequence
  source 1..19: mol_type = other RNA
ccataactcactcactaga

SEQ ID NO: 2405 - RNA, 19 nt, synthetic construct
  misc_feature 1..19: note = siRNA Sense Sequence
  source 1..19: mol_type = other RNA
tgagttatggtgctggcta

SEQ ID NO: 2406 - RNA, 19 nt, synthetic construct
  misc_feature 1..19: note = siRNA Antisense Sequence
  source 1..19: mol_type = other RNA
tagccagcaccataactca

SEQ ID NO: 2407 - RNA, 19 nt, synthetic construct
  misc_feature 1..19: note = siRNA Sense Sequence
  source 1..19: mol_type = other RNA
gagttatggtgctggctat

SEQ ID NO: 2408 - RNA, 19 nt, synthetic construct
  misc_feature 1..19: note = siRNA Antisense Sequence
  source 1..19: mol_type = other RNA
atagccagcaccataactc

SEQ ID NO: 2409 - RNA, 19 nt, synthetic construct
  misc_feature 1..19: note = siRNA Sense Sequence
  source 1..19: mol_type = other RNA
agttatggtgctggctata

SEQ ID NO: 2410 - RNA, 19 nt, synthetic construct
  misc_feature 1..19: note = siRNA Antisense Sequence
  source 1..19: mol_type = other RNA
tatagccagcaccataact

SEQ ID NO: 2411 - RNA, 19 nt, synthetic construct
  misc_feature 1..19: note = siRNA Sense Sequence
  source 1..19: mol_type = other RNA
gttatggtgctggctatat

SEQ ID NO: 2412 - RNA, 19 nt, synthetic construct
  misc_feature 1..19: note = siRNA Antisense Sequence
  source 1..19: mol_type = other RNA
atatagccagcaccataac

SEQ ID NO: 2413 - RNA, 19 nt, synthetic construct
  misc_feature 1..19: note = siRNA Sense Sequence
  source 1..19: mol_type = other RNA
ttatggtgctggctatatt

SEQ ID NO: 2414 - RNA, 19 nt, synthetic construct
  misc_feature 1..19: note = siRNA Antisense Sequence
  source 1..19: mol_type = other RNA
aatatagccagcaccataa

SEQ ID NO: 2415 - RNA, 19 nt, synthetic construct
  misc_feature 1..19: note = siRNA Sense Sequence
  source 1..19: mol_type = other RNA
tatggtgctggctatattt

SEQ ID NO: 2416 - RNA, 19 nt, synthetic construct
  misc_feature 1..19: note = siRNA Antisense Sequence
  source 1..19: mol_type = other RNA
aaatatagccagcaccata

SEQ ID NO: 2417 - RNA, 19 nt, synthetic construct
  misc_feature 1..19: note = siRNA Sense Sequence
  source 1..19: mol_type = other RNA
atggtgctggctatatttt

SEQ ID NO: 2418 - RNA, 19 nt, synthetic construct
  misc_feature 1..19: note = siRNA Antisense Sequence
  source 1..19: mol_type = other RNA
aaaatatagccagcaccat

SEQ ID NO: 2419 - RNA, 19 nt, synthetic construct
  misc_feature 1..19: note = siRNA Sense Sequence
  source 1..19: mol_type = other RNA
tggtgctggctatattttg

SEQ ID NO: 2420 - RNA, 19 nt, synthetic construct
  misc_feature 1..19: note = siRNA Antisense Sequence
  source 1..19: mol_type = other RNA
caaaatatagccagcacca

SEQ ID NO: 2421 - RNA, 19 nt, synthetic construct
  misc_feature 1..19: note = siRNA Sense Sequence
  source 1..19: mol_type = other RNA
ggtgctggctatattttgc

SEQ ID NO: 2422 - RNA, 19 nt, synthetic construct
  misc_feature 1..19: note = siRNA Antisense Sequence
  source 1..19: mol_type = other RNA
gcaaaatatagccagcacc

SEQ ID NO: 2423 - RNA, 19 nt, synthetic construct
  misc_feature 1..19: note = siRNA Sense Sequence
  source 1..19: mol_type = other RNA
tgccctctcaaatgttgct

SEQ ID NO: 2424 - RNA, 19 nt, synthetic construct
  misc_feature 1..19: note = siRNA Antisense Sequence
  source 1..19: mol_type = other RNA
agcaacatttgagagggca

SEQ ID NO: 2425 - RNA, 19 nt, synthetic construct
  misc_feature 1..19: note = siRNA Sense Sequence
  source 1..19: mol_type = other RNA
gccctctcaaatgttgcta

SEQ ID NO: 2426 - RNA, 19 nt, synthetic construct
  misc_feature 1..19: note = siRNA Antisense Sequence
  source 1..19: mol_type = other RNA
tagcaacatttgagagggc

SEQ ID NO: 2427 - RNA, 19 nt, synthetic construct
  misc_feature 1..19: note = siRNA Sense Sequence
  source 1..19: mol_type = other RNA
ccctctcaaatgttgctag

SEQ ID NO: 2428 - RNA, 19 nt, synthetic construct
  misc_feature 1..19: note = siRNA Antisense Sequence
  source 1..19: mol_type = other RNA
ctagcaacatttgagaggg

SEQ ID NO: 2429 - RNA, 19 nt, synthetic construct
  misc_feature 1..19: note = siRNA Sense Sequence
  source 1..19: mol_type = other RNA
cctctcaaatgttgctagg

SEQ ID NO: 2430 - RNA, 19 nt, synthetic construct
  misc_feature 1..19: note = siRNA Antisense Sequence
  source 1..19: mol_type = other RNA
cctagcaacatttgagagg

SEQ ID NO: 2431 - RNA, 19 nt, synthetic construct
  misc_feature 1..19: note = siRNA Sense Sequence
  source 1..19: mol_type = other RNA
ctctcaaatgttgctagga

SEQ ID NO: 2432 - RNA, 19 nt, synthetic construct
  misc_feature 1..19: note = siRNA Antisense Sequence
  source 1..19: mol_type = other RNA
tcctagcaacatttgagag

SEQ ID NO: 2433 - RNA, 19 nt, synthetic construct
  misc_feature 1..19: note = siRNA Sense Sequence
  source 1..19: mol_type = other RNA
aaatgttgctaggaattca

SEQ ID NO: 2434 - RNA, 19 nt, synthetic construct
  misc_feature 1..19: note = siRNA Antisense Sequence
  source 1..19: mol_type = other RNA
tgaattcctagcaacattt

SEQ ID NO: 2435 - RNA, 19 nt, synthetic construct
  misc_feature 1..19: note = siRNA Sense Sequence
  source 1..19: mol_type = other RNA
aatgttgctaggaattcat

SEQ ID NO: 2436 - RNA, 19 nt, synthetic construct
  misc_feature 1..19: note = siRNA Antisense Sequence
  source 1..19: mol_type = other RNA
atgaattcctagcaacatt

SEQ ID NO: 2437 - RNA, 19 nt, synthetic construct
  misc_feature 1..19: note = siRNA Sense Sequence
  source 1..19: mol_type = other RNA
atgttgctaggaattcata

SEQ ID NO: 2438 - RNA, 19 nt, synthetic construct
  misc_feature 1..19: note = siRNA Antisense Sequence
  source 1..19: mol_type = other RNA
tatgaattcctagcaacat

SEQ ID NO: 2439 - RNA, 19 nt, synthetic construct
  misc_feature 1..19: note = siRNA Sense Sequence
  source 1..19: mol_type = other RNA
tgttgctaggaattcatac

SEQ ID NO: 2440 - RNA, 19 nt, synthetic construct
  misc_feature 1..19: note = siRNA Antisense Sequence
  source 1..19: mol_type = other RNA
gtatgaattcctagcaaca

SEQ ID NO: 2441 - RNA, 19 nt, synthetic construct
  misc_feature 1..19: note = siRNA Sense Sequence
  source 1..19: mol_type = other RNA
gttgctaggaattcatact

SEQ ID NO: 2442 - RNA, 19 nt, synthetic construct
  misc_feature 1..19: note = siRNA Antisense Sequence
  source 1..19: mol_type = other RNA
agtatgaattcctagcaac

SEQ ID NO: 2443 - RNA, 19 nt, synthetic construct
  misc_feature 1..19: note = siRNA Sense Sequence
  source 1..19: mol_type = other RNA
ttgctaggaattcatactg

SEQ ID NO: 2444 - RNA, 19 nt, synthetic construct
  misc_feature 1..19: note = siRNA Antisense Sequence
  source 1..19: mol_type = other RNA
cagtatgaattcctagcaa

SEQ ID NO: 2445 - RNA, 19 nt, synthetic construct
  misc_feature 1..19: note = siRNA Sense Sequence
  source 1..19: mol_type = other RNA
tgctaggaattcatactgc

SEQ ID NO: 2446 - RNA, 19 nt, synthetic construct
  misc_feature 1..19: note = siRNA Antisense Sequence
  source 1..19: mol_type = other RNA
gcagtatgaattcctagca

SEQ ID NO: 2447 - RNA, 19 nt, synthetic construct
  misc_feature 1..19: note = siRNA Sense Sequence
  source 1..19: mol_type = other RNA
aaagcaatgaataagcatg

SEQ ID NO: 2448 - RNA, 19 nt, synthetic construct
  misc_feature 1..19: note = siRNA Antisense Sequence
  source 1..19: mol_type = other RNA
catgcttattcattgcttt

SEQ ID NO: 2449 - RNA, 19 nt, synthetic construct
  misc_feature 1..19: note = siRNA Sense Sequence
  source 1..19: mol_type = other RNA
aagcaatgaataagcatgc

SEQ ID NO: 2450 - RNA, 19 nt, synthetic construct
  misc_feature 1..19: note = siRNA Antisense Sequence
  source 1..19: mol_type = other RNA
gcatgcttattcattgctt

SEQ ID NO: 2451 - RNA, 19 nt, synthetic construct
  misc_feature 1..19: note = siRNA Sense Sequence
  source 1..19: mol_type = other RNA
agcaatgaataagcatgcc

SEQ ID NO: 2452 - RNA, 19 nt, synthetic construct
  misc_feature 1..19: note = siRNA Antisense Sequence
  source 1..19: mol_type = other RNA
ggcatgcttattcattgct

SEQ ID NO: 2453 - RNA, 19 nt, synthetic construct
  misc_feature 1..19: note = siRNA Sense Sequence
  source 1..19: mol_type = other RNA
gcaatgaataagcatgcct

SEQ ID NO: 2454 - RNA, 19 nt, synthetic construct
  misc_feature 1..19: note = siRNA Antisense Sequence
  source 1..19: mol_type = other RNA
aggcatgcttattcattgc

SEQ ID NO: 2455 - RNA, 19 nt, synthetic construct
  misc_feature 1..19: note = siRNA Sense Sequence
  source 1..19: mol_type = other RNA
aatgaataagcatgcctgt

SEQ ID NO: 2456 - RNA, 19 nt, synthetic construct
  misc_feature 1..19: note = siRNA Antisense Sequence
  source 1..19: mol_type = other RNA
acaggcatgcttattcatt

SEQ ID NO: 2457 - RNA, 19 nt, synthetic construct
  misc_feature 1..19: note = siRNA Sense Sequence
  source 1..19: mol_type = other RNA
atgaataagcatgcctgtt

SEQ ID NO: 2458 - RNA, 19 nt, synthetic construct
  misc_feature 1..19: note = siRNA Antisense Sequence
  source 1..19: mol_type = other RNA
aacaggcatgcttattcat

SEQ ID NO: 2459 - RNA, 19 nt, synthetic construct
  misc_feature 1..19: note = siRNA Sense Sequence
  source 1..19: mol_type = other RNA
tgaataagcatgcctgttt

SEQ ID NO: 2460 - RNA, 19 nt, synthetic construct
  misc_feature 1..19: note = siRNA Antisense Sequence
  source 1..19: mol_type = other RNA
aaacaggcatgcttattca

SEQ ID NO: 2461 - RNA, 19 nt, synthetic construct
  misc_feature 1..19: note = siRNA Sense Sequence
  source 1..19: mol_type = other RNA
gaataagcatgcctgtttt

SEQ ID NO: 2462 - RNA, 19 nt, synthetic construct
  misc_feature 1..19: note = siRNA Antisense Sequence
  source 1..19: mol_type = other RNA
aaaacaggcatgcttattc

SEQ ID NO: 2463 - RNA, 19 nt, synthetic construct
  misc_feature 1..19: note = siRNA Sense Sequence
  source 1..19: mol_type = other RNA
ataagcatgcctgttttcc

SEQ ID NO: 2464 - RNA, 19 nt, synthetic construct
  misc_feature 1..19: note = siRNA Antisense Sequence
  source 1..19: mol_type = other RNA
ggaaaacaggcatgcttat

SEQ ID NO: 2465 - RNA, 19 nt, synthetic construct
  misc_feature 1..19: note = siRNA Sense Sequence
  source 1..19: mol_type = other RNA
atgcctgttttcccatggc

SEQ ID NO: 2466 - RNA, 19 nt, synthetic construct
  misc_feature 1..19: note = siRNA Antisense Sequence
  source 1..19: mol_type = other RNA
gccatgggaaaacaggcat

SEQ ID NO: 2467 - RNA, 19 nt, synthetic construct
  misc_feature 1..19: note = siRNA Sense Sequence
  source 1..19: mol_type = other RNA
tgcctgttttcccatggcc

SEQ ID NO: 2468 - RNA, 19 nt, synthetic construct
  misc_feature 1..19: note = siRNA Antisense Sequence
  source 1..19: mol_type = other RNA
ggccatgggaaaacaggca

SEQ ID NO: 2469 - RNA, 19 nt, synthetic construct
  misc_feature 1..19: note = siRNA Sense Sequence
  source 1..19: mol_type = other RNA
gcctgttttcccatggcct

SEQ ID NO: 2470 - RNA, 19 nt, synthetic construct
  misc_feature 1..19: note = siRNA Antisense Sequence
  source 1..19: mol_type = other RNA
aggccatgggaaaacaggc

SEQ ID NO: 2471 - RNA, 19 nt, synthetic construct
  misc_feature 1..19: note = siRNA Sense Sequence
  source 1..19: mol_type = other RNA
cctgttttcccatggcctt

SEQ ID NO: 2472 - RNA, 19 nt, synthetic construct
  misc_feature 1..19: note = siRNA Antisense Sequence
  source 1..19: mol_type = other RNA
aaggccatgggaaaacagg

SEQ ID NO: 2473 - RNA, 19 nt, synthetic construct
  misc_feature 1..19: note = siRNA Sense Sequence
  source 1..19: mol_type = other RNA
ctgttttcccatggccttg

SEQ ID NO: 2474 - RNA, 19 nt, synthetic construct
  misc_feature 1..19: note = siRNA Antisense Sequence
  source 1..19: mol_type = other RNA
caaggccatgggaaaacag

SEQ ID NO: 2475 - RNA, 19 nt, synthetic construct
  misc_feature 1..19: note = siRNA Sense Sequence
  source 1..19: mol_type = other RNA
ttcccatggccttgcttgc

SEQ ID NO: 2476 - RNA, 19 nt, synthetic construct
  misc_feature 1..19: note = siRNA Antisense Sequence
  source 1..19: mol_type = other RNA
gcaagcaaggccatgggaa

SEQ ID NO: 2477 - RNA, 19 nt, synthetic construct
  misc_feature 1..19: note = siRNA Sense Sequence
  source 1..19: mol_type = other RNA
ggccttgcttgccagaatt

SEQ ID NO: 2478 - RNA, 19 nt, synthetic construct
  misc_feature 1..19: note = siRNA Antisense Sequence
  source 1..19: mol_type = other RNA
aattctggcaagcaaggcc

SEQ ID NO: 2479 - RNA, 19 nt, synthetic construct
  misc_feature 1..19: note = siRNA Sense Sequence
  source 1..19: mol_type = other RNA
ttgcttgccagaatttgac

SEQ ID NO: 2480 - RNA, 19 nt, synthetic construct
  misc_feature 1..19: note = siRNA Antisense Sequence
  source 1..19: mol_type = other RNA
gtcaaattctggcaagcaa

SEQ ID NO: 2481 - RNA, 19 nt, synthetic construct
  misc_feature 1..19: note = siRNA Sense Sequence
  source 1..19: mol_type = other RNA
tgcttgccagaatttgact

SEQ ID NO: 2482 - RNA, 19 nt, synthetic construct
  misc_feature 1..19: note = siRNA Antisense Sequence
  source 1..19: mol_type = other RNA
agtcaaattctggcaagca

SEQ ID NO: 2483 - RNA, 19 nt, synthetic construct
  misc_feature 1..19: note = siRNA Sense Sequence
  source 1..19: mol_type = other RNA
gcttgccagaatttgactt

SEQ ID NO: 2484 - RNA, 19 nt, synthetic construct
  misc_feature 1..19: note = siRNA Antisense Sequence
  source 1..19: mol_type = other RNA
aagtcaaattctggcaagc

SEQ ID NO: 2485 - RNA, 19 nt, synthetic construct
  misc_feature 1..19: note = siRNA Sense Sequence
  source 1..19: mol_type = other RNA
cttgccagaatttgacttt

SEQ ID NO: 2486 - RNA, 19 nt, synthetic construct
  misc_feature 1..19: note = siRNA Antisense Sequence
  source 1..19: mol_type = other RNA
aaagtcaaattctggcaag

SEQ ID NO: 2487 - RNA, 19 nt, synthetic construct
  misc_feature 1..19: note = siRNA Sense Sequence
  source 1..19: mol_type = other RNA
ttgccagaatttgactttt

SEQ ID NO: 2488 - RNA, 19 nt, synthetic construct
  misc_feature 1..19: note = siRNA Antisense Sequence
  source 1..19: mol_type = other RNA
aaaagtcaaattctggcaa

SEQ ID NO: 2489 - RNA, 19 nt, synthetic construct
  misc_feature 1..19: note = siRNA Sense Sequence
  source 1..19: mol_type = other RNA
gatatactactattgcttg

SEQ ID NO: 2490 - RNA, 19 nt, synthetic construct
  misc_feature 1..19: note = siRNA Antisense Sequence
  source 1..19: mol_type = other RNA
caagcaatagtagtatatc

SEQ ID NO: 2491 - RNA, 19 nt, synthetic construct
  misc_feature 1..19: note = siRNA Sense Sequence
  source 1..19: mol_type = other RNA
atattgtggtatacggtgt

SEQ ID NO: 2492 - RNA, 19 nt, synthetic construct
  misc_feature 1..19: note = siRNA Antisense Sequence
  source 1..19: mol_type = other RNA
acaccgtataccacaatat

SEQ ID NO: 2493 - RNA, 19 nt, synthetic construct
  misc_feature 1..19: note = siRNA Sense Sequence
  source 1..19: mol_type = other RNA
tattgtggtatacggtgtc

SEQ ID NO: 2494 - RNA, 19 nt, synthetic construct
  misc_feature 1..19: note = siRNA Antisense Sequence
  source 1..19: mol_type = other RNA
gacaccgtataccacaata

SEQ ID NO: 2495 - RNA, 19 nt, synthetic construct
  misc_feature 1..19: note = siRNA Sense Sequence
  source 1..19: mol_type = other RNA
attgtggtatacggtgtca

SEQ ID NO: 2496 - RNA, 19 nt, synthetic construct
  misc_feature 1..19: note = siRNA Antisense Sequence
  source 1..19: mol_type = other RNA
tgacaccgtataccacaat

SEQ ID NO: 2497 - RNA, 19 nt, synthetic construct
  misc_feature 1..19: note = siRNA Sense Sequence
  source 1..19: mol_type = other RNA
ttgtggtatacggtgtcag

SEQ ID NO: 2498 - RNA, 19 nt, synthetic construct
  misc_feature 1..19: note = siRNA Antisense Sequence
  source 1..19: mol_type = other RNA
ctgacaccgtataccacaa

SEQ ID NO: 2499 - RNA, 19 nt, synthetic construct
  misc_feature 1..19: note = siRNA Sense Sequence
  source 1..19: mol_type = other RNA
tgtggtatacggtgtcagg

SEQ ID NO: 2500 - RNA, 19 nt, synthetic construct
  misc_feature 1..19: note = siRNA Antisense Sequence
  source 1..19: mol_type = other RNA
cctgacaccgtataccaca

SEQ ID NO: 2501 - RNA, 19 nt, synthetic construct
  misc_feature 1..19: note = siRNA Sense Sequence
  source 1..19: mol_type = other RNA
gtggtatacggtgtcaggt

SEQ ID NO: 2502 - RNA, 19 nt, synthetic construct
  misc_feature 1..19: note = siRNA Antisense Sequence
  source 1..19: mol_type = other RNA
acctgacaccgtataccac

SEQ ID NO: 2503 - RNA, 19 nt, synthetic construct
  misc_feature 1..19: note = siRNA Sense Sequence
  source 1..19: mol_type = other RNA
tatacggtgtcaggtttca

SEQ ID NO: 2504 - RNA, 19 nt, synthetic construct
  misc_feature 1..19: note = siRNA Antisense Sequence
  source 1..19: mol_type = other RNA
tgaaacctgacaccgtata

SEQ ID NO: 2505 - RNA, 19 nt, synthetic construct
  misc_feature 1..19: note = siRNA Sense Sequence
  source 1..19: mol_type = other RNA
atacggtgtcaggtttcag

SEQ ID NO: 2506 - RNA, 19 nt, synthetic construct
  misc_feature 1..19: note = siRNA Antisense Sequence
  source 1..19: mol_type = other RNA
ctgaaacctgacaccgtat

SEQ ID NO: 2507 - RNA, 19 nt, synthetic construct
  misc_feature 1..19: note = siRNA Sense Sequence
  source 1..19: mol_type = other RNA
tacggtgtcaggtttcagg

SEQ ID NO: 2508 - RNA, 19 nt, synthetic construct
  misc_feature 1..19: note = siRNA Antisense Sequence
  source 1..19: mol_type = other RNA
cctgaaacctgacaccgta

SEQ ID NO: 2509 - RNA, 19 nt, synthetic construct
  misc_feature 1..19: note = siRNA Sense Sequence
  source 1..19: mol_type = other RNA
tgtcaggtttcagggtttt

SEQ ID NO: 2510 - RNA, 19 nt, synthetic construct
  misc_feature 1..19: note = siRNA Antisense Sequence
  source 1..19: mol_type = other RNA
aaaaccctgaaacctgaca

SEQ ID NO: 2511 - RNA, 19 nt, synthetic construct
  misc_feature 1..19: note = siRNA Sense Sequence
  source 1..19: mol_type = other RNA
ttcatttcaaatactccct

SEQ ID NO: 2512 - RNA, 19 nt, synthetic construct
  misc_feature 1..19: note = siRNA Antisense Sequence
  source 1..19: mol_type = other RNA
agggagtatttgaaatgaa

SEQ ID NO: 2513 - RNA, 19 nt, synthetic construct
  misc_feature 1..19: note = siRNA Sense Sequence
  source 1..19: mol_type = other RNA
catttcaaatactcccttt

SEQ ID NO: 2514 - RNA, 19 nt, synthetic construct
  misc_feature 1..19: note = siRNA Antisense Sequence
  source 1..19: mol_type = other RNA
aaagggagtatttgaaatg

SEQ ID NO: 2515 - RNA, 19 nt, synthetic construct
  misc_feature 1..19: note = siRNA Sense Sequence
  source 1..19: mol_type = other RNA
taggtataactgttgatga

SEQ ID NO: 2516 - RNA, 19 nt, synthetic construct
  misc_feature 1..19: note = siRNA Antisense Sequence
  source 1..19: mol_type = other RNA
tcatcaacagttataccta

SEQ ID NO: 2517 - RNA, 19 nt, synthetic construct
  misc_feature 1..19: note = siRNA Sense Sequence
  source 1..19: mol_type = other RNA
aggtataactgttgatgaa

SEQ ID NO: 2518 - RNA, 19 nt, synthetic construct
  misc_feature 1..19: note = siRNA Antisense Sequence
  source 1..19: mol_type = other RNA
ttcatcaacagttatacct

SEQ ID NO: 2519 - RNA, 19 nt, synthetic construct
  misc_feature 1..19: note = siRNA Sense Sequence
  source 1..19: mol_type = other RNA
ttattgtccatttataccc

SEQ ID NO: 2520 - RNA, 19 nt, synthetic construct
  misc_feature 1..19: note = siRNA Antisense Sequence
  source 1..19: mol_type = other RNA
gggtataaatggacaataa

SEQ ID NO: 2521 - RNA, 19 nt, synthetic construct
  misc_feature 1..19: note = siRNA Sense Sequence
  source 1..19: mol_type = other RNA
tattgtccatttataccct

SEQ ID NO: 2522 - RNA, 19 nt, synthetic construct
  misc_feature 1..19: note = siRNA Antisense Sequence
  source 1..19: mol_type = other RNA
agggtataaatggacaata

SEQ ID NO: 2523 - RNA, 19 nt, synthetic construct
  misc_feature 1..19: note = siRNA Sense Sequence
  source 1..19: mol_type = other RNA
attgtccatttataccctg

SEQ ID NO: 2524 - RNA, 19 nt, synthetic construct
  misc_feature 1..19: note = siRNA Antisense Sequence
  source 1..19: mol_type = other RNA
cagggtataaatggacaat

SEQ ID NO: 2525 - RNA, 19 nt, synthetic construct
  misc_feature 1..19: note = siRNA Sense Sequence
  source 1..19: mol_type = other RNA
ttgtccatttataccctgt

SEQ ID NO: 2526 - RNA, 19 nt, synthetic construct
  misc_feature 1..19: note = siRNA Antisense Sequence
  source 1..19: mol_type = other RNA
acagggtataaatggacaa

SEQ ID NO: 2527 - RNA, 19 nt, synthetic construct
  misc_feature 1..19: note = siRNA Sense Sequence
  source 1..19: mol_type = other RNA
tgtccatttataccctgta

SEQ ID NO: 2528 - RNA, 19 nt, synthetic construct
  misc_feature 1..19: note = siRNA Antisense Sequence
  source 1..19: mol_type = other RNA
tacagggtataaatggaca

SEQ ID NO: 2529 - RNA, 19 nt, synthetic construct
  misc_feature 1..19: note = siRNA Sense Sequence
  source 1..19: mol_type = other RNA
gtccatttataccctgtaa

SEQ ID NO: 2530 - RNA, 19 nt, synthetic construct
  misc_feature 1..19: note = siRNA Antisense Sequence
  source 1..19: mol_type = other RNA
ttacagggtataaatggac

SEQ ID NO: 2531 - RNA, 19 nt, synthetic construct
  misc_feature 1..19: note = siRNA Sense Sequence
  source 1..19: mol_type = other RNA
tataccctgtaaagccgtt

SEQ ID NO: 2532 - RNA, 19 nt, synthetic construct
  misc_feature 1..19: note = siRNA Antisense Sequence
  source 1..19: mol_type = other RNA
aacggctttacagggtata

SEQ ID NO: 2533 - RNA, 19 nt, synthetic construct
  misc_feature 1..19: note = siRNA Sense Sequence
  source 1..19: mol_type = other RNA
ataccctgtaaagccgttt

SEQ ID NO: 2534 - RNA, 19 nt, synthetic construct
  misc_feature 1..19: note = siRNA Antisense Sequence
  source 1..19: mol_type = other RNA
aaacggctttacagggtat

SEQ ID NO: 2535 - RNA, 19 nt, synthetic construct
  misc_feature 1..19: note = siRNA Sense Sequence
  source 1..19: mol_type = other RNA
taccctgtaaagccgtttt

SEQ ID NO: 2536 - RNA, 19 nt, synthetic construct
  misc_feature 1..19: note = siRNA Antisense Sequence
  source 1..19: mol_type = other RNA
aaaacggctttacagggta

SEQ ID NO: 2537 - RNA, 19 nt, synthetic construct
  misc_feature 1..19: note = siRNA Sense Sequence
  source 1..19: mol_type = other RNA
agccgttttagaatgtaat

SEQ ID NO: 2538 - RNA, 19 nt, synthetic construct
  misc_feature 1..19: note = siRNA Antisense Sequence
  source 1..19: mol_type = other RNA
attacattctaaaacggct

SEQ ID NO: 2539 - RNA, 19 nt, synthetic construct
  misc_feature 1..19: note = siRNA Sense Sequence
  source 1..19: mol_type = other RNA
gccgttttagaatgtaata

SEQ ID NO: 2540 - RNA, 19 nt, synthetic construct
  misc_feature 1..19: note = siRNA Antisense Sequence
  source 1..19: mol_type = other RNA
tattacattctaaaacggc

SEQ ID NO: 2541 - RNA, 19 nt, synthetic construct
  misc_feature 1..19: note = siRNA Sense Sequence
  source 1..19: mol_type = other RNA
aggtaatccaaaatgtact

SEQ ID NO: 2542 - RNA, 19 nt, synthetic construct
  misc_feature 1..19: note = siRNA Antisense Sequence
  source 1..19: mol_type = other RNA
agtacattttggattacct

SEQ ID NO: 2543 - RNA, 19 nt, synthetic construct
  misc_feature 1..19: note = siRNA Sense Sequence
  source 1..19: mol_type = other RNA
ggtaatccaaaatgtacta

SEQ ID NO: 2544 - RNA, 19 nt, synthetic construct
  misc_feature 1..19: note = siRNA Antisense Sequence
  source 1..19: mol_type = other RNA
tagtacattttggattacc

SEQ ID NO: 2545 - RNA, 19 nt, synthetic construct
  misc_feature 1..19: note = siRNA Sense Sequence
  source 1..19: mol_type = other RNA
acatttgtattgtctcttc

SEQ ID NO: 2546 - RNA, 19 nt, synthetic construct
  misc_feature 1..19: note = siRNA Antisense Sequence
  source 1..19: mol_type = other RNA
gaagagacaatacaaatgt

SEQ ID NO: 2547 - RNA, 19 nt, synthetic construct
  misc_feature 1..19: note = siRNA Sense Sequence
  source 1..19: mol_type = other RNA
catttgtattgtctcttct

SEQ ID NO: 2548 - RNA, 19 nt, synthetic construct
  misc_feature 1..19: note = siRNA Antisense Sequence
  source 1..19: mol_type = other RNA
agaagagacaatacaaatg

SEQ ID NO: 2549 - RNA, 19 nt, synthetic construct
  misc_feature 1..19: note = siRNA Sense Sequence
  source 1..19: mol_type = other RNA
ttgtatcgcaaagctatat

SEQ ID NO: 2550 - RNA, 19 nt, synthetic construct
  misc_feature 1..19: note = siRNA Antisense Sequence
  source 1..19: mol_type = other RNA
atatagctttgcgatacaa

SEQ ID NO: 2551 - RNA, 19 nt, synthetic construct
  misc_feature 1..19: note = siRNA Sense Sequence
  source 1..19: mol_type = other RNA
tgtatcgcaaagctatatg

SEQ ID NO: 2552 - RNA, 19 nt, synthetic construct
  misc_feature 1..19: note = siRNA Antisense Sequence
  source 1..19: mol_type = other RNA
catatagctttgcgataca

SEQ ID NO: 2553 - RNA, 19 nt, synthetic construct
  misc_feature 1..19: note = siRNA Sense Sequence
  source 1..19: mol_type = other RNA
gtatcgcaaagctatatgt

SEQ ID NO: 2554 - RNA, 19 nt, synthetic construct
  misc_feature 1..19: note = siRNA Antisense Sequence
  source 1..19: mol_type = other RNA
acatatagctttgcgatac

SEQ ID NO: 2555 - RNA, 19 nt, synthetic construct
  misc_feature 1..19: note = siRNA Sense Sequence
  source 1..19: mol_type = other RNA
tatcgcaaagctatatgtg

SEQ ID NO: 2556 - RNA, 19 nt, synthetic construct
  misc_feature 1..19: note = siRNA Antisense Sequence
  source 1..19: mol_type = other RNA
cacatatagctttgcgata

SEQ ID NO: 2557 - RNA, 19 nt, synthetic construct
  misc_feature 1..19: note = siRNA Sense Sequence
  source 1..19: mol_type = other RNA
atcgcaaagctatatgtgc

SEQ ID NO: 2558 - RNA, 19 nt, synthetic construct
  misc_feature 1..19: note = siRNA Antisense Sequence
  source 1..19: mol_type = other RNA
gcacatatagctttgcgat

SEQ ID NO: 2559 - RNA, 19 nt, synthetic construct
  misc_feature 1..19: note = siRNA Sense Sequence
  source 1..19: mol_type = other RNA
tcgcaaagctatatgtgca

SEQ ID NO: 2560 - RNA, 19 nt, synthetic construct
  misc_feature 1..19: note = siRNA Antisense Sequence
  source 1..19: mol_type = other RNA
tgcacatatagctttgcga

SEQ ID NO: 2561 - RNA, 19 nt, synthetic construct
  misc_feature 1..19: note = siRNA Sense Sequence
  source 1..19: mol_type = other RNA
tgatctatgctttgagttt

SEQ ID NO: 2562 - RNA, 19 nt, synthetic construct
  misc_feature 1..19: note = siRNA Antisense Sequence
  source 1..19: mol_type = other RNA
aaactcaaagcatagatca

SEQ ID NO: 2563 - RNA, 19 nt, synthetic construct
  misc_feature 1..19: note = siRNA Sense Sequence
  source 1..19: mol_type = other RNA
gatctatgctttgagtttg

SEQ ID NO: 2564 - RNA, 19 nt, synthetic construct
  misc_feature 1..19: note = siRNA Antisense Sequence
  source 1..19: mol_type = other RNA
caaactcaaagcatagatc

SEQ ID NO: 2565 - RNA, 19 nt, synthetic construct
  misc_feature 1..19: note = siRNA Sense Sequence
  source 1..19: mol_type = other RNA
atctatgctttgagtttgc

SEQ ID NO: 2566 - RNA, 19 nt, synthetic construct
  misc_feature 1..19: note = siRNA Antisense Sequence
  source 1..19: mol_type = other RNA
gcaaactcaaagcatagat

SEQ ID NO: 2567 - RNA, 19 nt, synthetic construct
  misc_feature 1..19: note = siRNA Sense Sequence
  source 1..19: mol_type = other RNA
tctatgctttgagtttgct

SEQ ID NO: 2568 - RNA, 19 nt, synthetic construct
  misc_feature 1..19: note = siRNA Antisense Sequence
  source 1..19: mol_type = other RNA
agcaaactcaaagcataga

SEQ ID NO: 2569 - RNA, 19 nt, synthetic construct
  misc_feature 1..19: note = siRNA Sense Sequence
  source 1..19: mol_type = other RNA
ctatgctttgagtttgctt

SEQ ID NO: 2570 - RNA, 19 nt, synthetic construct
  misc_feature 1..19: note = siRNA Antisense Sequence
  source 1..19: mol_type = other RNA
aagcaaactcaaagcatag

SEQ ID NO: 2571 - RNA, 19 nt, synthetic construct
  misc_feature 1..19: note = siRNA Sense Sequence
  source 1..19: mol_type = other RNA
tatgctttgagtttgcttt

SEQ ID NO: 2572 - RNA, 19 nt, synthetic construct
  misc_feature 1..19: note = siRNA Antisense Sequence
  source 1..19: mol_type = other RNA
aaagcaaactcaaagcata

SEQ ID NO: 2573 - RNA, 19 nt, synthetic construct
  misc_feature 1..19: note = siRNA Sense Sequence
  source 1..19: mol_type = other RNA
atgctttgagtttgctttc

SEQ ID NO: 2574 - RNA, 19 nt, synthetic construct
  misc_feature 1..19: note = siRNA Antisense Sequence
  source 1..19: mol_type = other RNA
gaaagcaaactcaaagcat

SEQ ID NO: 2575 - RNA, 19 nt, synthetic construct
  misc_feature 1..19: note = siRNA Sense Sequence
  source 1..19: mol_type = other RNA
atcttacctaaaagtactg

SEQ ID NO: 2576 - RNA, 19 nt, synthetic construct
  misc_feature 1..19: note = siRNA Antisense Sequence
  source 1..19: mol_type = other RNA
cagtacttttaggtaagat

SEQ ID NO: 2577 - RNA, 19 nt, synthetic construct
  misc_feature 1..19: note = siRNA Sense Sequence
  source 1..19: mol_type = other RNA
cttacctaaaagtactgaa

SEQ ID NO: 2578 - RNA, 19 nt, synthetic construct
  misc_feature 1..19: note = siRNA Antisense Sequence
  source 1..19: mol_type = other RNA
ttcagtacttttaggtaag

SEQ ID NO: 2579 - RNA, 20 nt, synthetic construct
  misc_feature 1..20: note = Antisense Sequence
  source 1..20: mol_type = other RNA
tgcagacaaggctctcggag

SEQ ID NO: 2580 - RNA, 20 nt, synthetic construct
  misc_feature 1..20: note = Antisense Sequence
  source 1..20: mol_type = other RNA
atgcagacaaggctctcgga

SEQ ID NO: 2581 - RNA, 20 nt, synthetic construct
  misc_feature 1..20: note = Antisense Sequence
  source 1..20: mol_type = other RNA
aatgcagacaaggctctcgg

SEQ ID NO: 2582 - RNA, 20 nt, synthetic construct
  misc_feature 1..20: note = Antisense Sequence
  source 1..20: mol_type = other RNA
caatgcagacaaggctctcg

SEQ ID NO: 2583 - RNA, 20 nt, synthetic construct
  misc_feature 1..20: note = Antisense Sequence
  source 1..20: mol_type = other RNA
ccaatgcagacaaggctctc

SEQ ID NO: 2584 - RNA, 20 nt, synthetic construct
  misc_feature 1..20: note = Antisense Sequence
  source 1..20: mol_type = other RNA
cccaatgcagacaaggctct

SEQ ID NO: 2585 - RNA, 20 nt, synthetic construct
  misc_feature 1..20: note = Antisense Sequence
  source 1..20: mol_type = other RNA
agaagtgaaactcgtgggag

SEQ ID NO: 2586 - RNA, 20 nt, synthetic construct
  misc_feature 1..20: note = Antisense Sequence
  source 1..20: mol_type = other RNA
aagaagtgaaactcgtggga

SEQ ID NO: 2587 - RNA, 20 nt, synthetic construct
  misc_feature 1..20: note = Antisense Sequence
  source 1..20: mol_type = other RNA
gaagaagtgaaactcgtggg

SEQ ID NO: 2588 - RNA, 20 nt, synthetic construct
  misc_feature 1..20: note = Antisense Sequence
  source 1..20: mol_type = other RNA
agaagaagtgaaactcgtgg

SEQ ID NO: 2589 - RNA, 20 nt, synthetic construct
  misc_feature 1..20: note = Antisense Sequence
  source 1..20: mol_type = other RNA
gagaagaagtgaaactcgtg

SEQ ID NO: 2590 - RNA, 20 nt, synthetic construct
  misc_feature 1..20: note = Antisense Sequence
  source 1..20: mol_type = other RNA
ggagaagaagtgaaactcgt

SEQ ID NO: 2591 - RNA, 20 nt, synthetic construct
  misc_feature 1..20: note = Antisense Sequence
  source 1..20: mol_type = other RNA
ttgggagaagaagtgaaact

SEQ ID NO: 2592 - RNA, 20 nt, synthetic construct
  misc_feature 1..20: note = Antisense Sequence
  source 1..20: mol_type = other RNA
gttgggagaagaagtgaaac

SEQ ID NO: 2593 - RNA, 20 nt, synthetic construct
  misc_feature 1..20: note = Antisense Sequence
  source 1..20: mol_type = other RNA
aggttgggagaagaagtgaa

SEQ ID NO: 2594 - RNA, 20 nt, synthetic construct
  misc_feature 1..20: note = Antisense Sequence
  source 1..20: mol_type = other RNA
ataggttgggagaagaagtg

SEQ ID NO: 2595 - RNA, 20 nt, synthetic construct
  misc_feature 1..20: note = Antisense Sequence
  source 1..20: mol_type = other RNA
gacataggttgggagaagaa

SEQ ID NO: 2596 - RNA, 20 nt, synthetic construct
  misc_feature 1..20: note = Antisense Sequence
  source 1..20: mol_type = other RNA
cgacataggttgggagaaga

SEQ ID NO: 2597 - RNA, 20 nt, synthetic construct
  misc_feature 1..20: note = Antisense Sequence
  source 1..20: mol_type = other RNA
ccgacataggttgggagaag

SEQ ID NO: 2598 - RNA, 20 nt, synthetic construct
  misc_feature 1..20: note = Antisense Sequence
  source 1..20: mol_type = other RNA
cccgacataggttgggagaa

SEQ ID NO: 2599 - RNA, 20 nt, synthetic construct
  misc_feature 1..20: note = Antisense Sequence
  source 1..20: mol_type = other RNA
acccgacataggttgggaga

SEQ ID NO: 2600 - RNA, 20 nt, synthetic construct
  misc_feature 1..20: note = Antisense Sequence
  source 1..20: mol_type = other RNA
gacccgacataggttgggag

SEQ ID NO: 2601 - RNA, 20 nt, synthetic construct
  misc_feature 1..20: note = Antisense Sequence
  source 1..20: mol_type = other RNA
ggacccgacataggttggga

SEQ ID NO: 2602 - RNA, 20 nt, synthetic construct
  misc_feature 1..20: note = Antisense Sequence
  source 1..20: mol_type = other RNA
aggacccgacataggttggg

SEQ ID NO: 2603 - RNA, 20 nt, synthetic construct
  misc_feature 1..20: note = Antisense Sequence
  source 1..20: mol_type = other RNA
aaggacccgacataggttgg

SEQ ID NO: 2604 - RNA, 20 nt, synthetic construct
  misc_feature 1..20: note = Antisense Sequence
  source 1..20: mol_type = other RNA
gaaggacccgacataggttg

SEQ ID NO: 2605 - RNA, 20 nt, synthetic construct
  misc_feature 1..20: note = Antisense Sequence
  source 1..20: mol_type = other RNA
agaaggacccgacataggtt

SEQ ID NO: 2606 - RNA, 20 nt, synthetic construct
  misc_feature 1..20: note = Antisense Sequence
  source 1..20: mol_type = other RNA
aagaaggacccgacataggt

SEQ ID NO: 2607 - RNA, 20 nt, synthetic construct
  misc_feature 1..20: note = Antisense Sequence
  source 1..20: mol_type = other RNA
gaagaaggacccgacatagg

SEQ ID NO: 2608 - RNA, 20 nt, synthetic construct
  misc_feature 1..20: note = Antisense Sequence
  source 1..20: mol_type = other RNA
ggaagaaggacccgacatag

SEQ ID NO: 2609 - RNA, 20 nt, synthetic construct
  misc_feature 1..20: note = Antisense Sequence
  source 1..20: mol_type = other RNA
tggaagaaggacccgacata

SEQ ID NO: 2610 - RNA, 20 nt, synthetic construct
  misc_feature 1..20: note = Antisense Sequence
  source 1..20: mol_type = other RNA
ctggaagaaggacccgacat

SEQ ID NO: 2611 - RNA, 20 nt, synthetic construct
  misc_feature 1..20: note = Antisense Sequence
  source 1..20: mol_type = other RNA
cctggaagaaggacccgaca

SEQ ID NO: 2612 - RNA, 20 nt, synthetic construct
  misc_feature 1..20: note = Antisense Sequence
  source 1..20: mol_type = other RNA
cacgagtatcctggaagaag

SEQ ID NO: 2613 - RNA, 20 nt, synthetic construct
  misc_feature 1..20: note = Antisense Sequence
  source 1..20: mol_type = other RNA
tcacgagtatcctggaagaa

SEQ ID NO: 2614 - RNA, 20 nt, synthetic construct
  misc_feature 1..20: note = Antisense Sequence
  source 1..20: mol_type = other RNA
gtcacgagtatcctggaaga

SEQ ID NO: 2615 - RNA, 20 nt, synthetic construct
  misc_feature 1..20: note = Antisense Sequence
  source 1..20: mol_type = other RNA
cgtcacgagtatcctggaag

SEQ ID NO: 2616 - RNA, 20 nt, synthetic construct
  misc_feature 1..20: note = Antisense Sequence
  source 1..20: mol_type = other RNA
cgcgtcacgagtatcctgga

SEQ ID NO: 2617 - RNA, 20 nt, synthetic construct
  misc_feature 1..20: note = Antisense Sequence
  source 1..20: mol_type = other RNA
acacccgacacccaatggga

SEQ ID NO: 2618 - RNA, 20 nt, synthetic construct
  misc_feature 1..20: note = Antisense Sequence
  source 1..20: mol_type = other RNA
agacacccgacacccaatgg

SEQ ID NO: 2619 - RNA, 20 nt, synthetic construct
  misc_feature 1..20: note = Antisense Sequence
  source 1..20: mol_type = other RNA
tagacacccgacacccaatg

SEQ ID NO: 2620 - RNA, 20 nt, synthetic construct
  misc_feature 1..20: note = Antisense Sequence
  source 1..20: mol_type = other RNA
ctagacacccgacacccaat

SEQ ID NO: 2621 - RNA, 20 nt, synthetic construct
  misc_feature 1..20: note = Antisense Sequence
  source 1..20: mol_type = other RNA
cggcgacactgattggcttc

SEQ ID NO: 2622 - RNA, 20 nt, synthetic construct
  misc_feature 1..20: note = Antisense Sequence
  source 1..20: mol_type = other RNA
ggactttagaactgggaccc

SEQ ID NO: 2623 - RNA, 20 nt, synthetic construct
  misc_feature 1..20: note = Antisense Sequence
  source 1..20: mol_type = other RNA
attctgagtccgggtgggtg

SEQ ID NO: 2624 - RNA, 20 nt, synthetic construct
  misc_feature 1..20: note = Antisense Sequence
  source 1..20: mol_type = other RNA
gattctgagtccgggtgggt

SEQ ID NO: 2625 - RNA, 20 nt, synthetic construct
  misc_feature 1..20: note = Antisense Sequence
  source 1..20: mol_type = other RNA
agattctgagtccgggtggg

SEQ ID NO: 2626 - RNA, 20 nt, synthetic construct
  misc_feature 1..20: note = Antisense Sequence
  source 1..20: mol_type = other RNA
gagattctgagtccgggtgg

SEQ ID NO: 2627 - RNA, 20 nt, synthetic construct
  misc_feature 1..20: note = Antisense Sequence
  source 1..20: mol_type = other RNA
ggagattctgagtccgggtg

SEQ ID NO: 2628 - RNA, 20 nt, synthetic construct
  misc_feature 1..20: note = Antisense Sequence
  source 1..20: mol_type = other RNA
aggagattctgagtccgggt

SEQ ID NO: 2629 - RNA, 20 nt, synthetic construct
  misc_feature 1..20: note = Antisense Sequence
  source 1..20: mol_type = other RNA
gaggagattctgagtccggg

SEQ ID NO: 2630 - RNA, 20 nt, synthetic construct
  misc_feature 1..20: note = Antisense Sequence
  source 1..20: mol_type = other RNA
tgaggagattctgagtccgg

SEQ ID NO: 2631 - RNA, 20 nt, synthetic construct
  misc_feature 1..20: note = Antisense Sequence
  source 1..20: mol_type = other RNA
tctgaggagattctgagtcc

SEQ ID NO: 2632 - RNA, 20 nt, synthetic construct
  misc_feature 1..20: note = Antisense Sequence
  source 1..20: mol_type = other RNA
gtctgaggagattctgagtc

SEQ ID NO: 2633 - RNA, 20 nt, synthetic construct
  misc_feature 1..20: note = Antisense Sequence
  source 1..20: mol_type = other RNA
cgtctgaggagattctgagt

SEQ ID NO: 2634 - RNA, 20 nt, synthetic construct
  misc_feature 1..20: note = Antisense Sequence
  source 1..20: mol_type = other RNA
ggcgtctgaggagattctga

SEQ ID NO: 2635 - RNA, 20 nt, synthetic construct
  misc_feature 1..20: note = Antisense Sequence
  source 1..20: mol_type = other RNA
cggcgtctgaggagattctg

SEQ ID NO: 2636 - RNA, 20 nt, synthetic construct
  misc_feature 1..20: note = Antisense Sequence
  source 1..20: mol_type = other RNA
tcggcgtctgaggagattct

SEQ ID NO: 2637 - RNA, 20 nt, synthetic construct
  misc_feature 1..20: note = Antisense Sequence
  source 1..20: mol_type = other RNA
ctcggcgtctgaggagattc

SEQ ID NO: 2638 - RNA, 20 nt, synthetic construct
  misc_feature 1..20: note = Antisense Sequence
  source 1..20: mol_type = other RNA
tgtggaaatacctcatggag

SEQ ID NO: 2639 - RNA, 20 nt, synthetic construct
  misc_feature 1..20: note = Antisense Sequence
  source 1..20: mol_type = other RNA
ggtgtggaaatacctcatgg

SEQ ID NO: 2640 - RNA, 20 nt, synthetic construct
  misc_feature 1..20: note = Antisense Sequence
  source 1..20: mol_type = other RNA
cacggaggtgtggaaatacc

SEQ ID NO: 2641 - RNA, 20 nt, synthetic construct
  misc_feature 1..20: note = Antisense Sequence
  source 1..20: mol_type = other RNA
tagcccacggtgatgaagcg

SEQ ID NO: 2642 - RNA, 20 nt, synthetic construct
  misc_feature 1..20: note = Antisense Sequence
  source 1..20: mol_type = other RNA
gtagcccacggtgatgaagc

SEQ ID NO: 2643 - RNA, 20 nt, synthetic construct
  misc_feature 1..20: note = Antisense Sequence
  source 1..20: mol_type = other RNA
cgtagcccacggtgatgaag

SEQ ID NO: 2644 - RNA, 20 nt, synthetic construct
  misc_feature 1..20: note = Antisense Sequence
  source 1..20: mol_type = other RNA
acgtagcccacggtgatgaa

SEQ ID NO: 2645 - RNA, 20 nt, synthetic construct
  misc_feature 1..20: note = Antisense Sequence
  source 1..20: mol_type = other RNA
cacgtagcccacggtgatga

SEQ ID NO: 2646 - RNA, 20 nt, synthetic construct
  misc_feature 1..20: note = Antisense Sequence
  source 1..20: mol_type = other RNA
tccacgtagcccacggtgat

SEQ ID NO: 2647 - RNA, 20 nt, synthetic construct
  misc_feature 1..20: note = Antisense Sequence
  source 1..20: mol_type = other RNA
tcgaacctcacgaacagcgt

SEQ ID NO: 2648 - RNA, 20 nt, synthetic construct
  misc_feature 1..20: note = Antisense Sequence
  source 1..20: mol_type = other RNA
gtcgaacctcacgaacagcg

SEQ ID NO: 2649 - RNA, 20 nt, synthetic construct
  misc_feature 1..20: note = Antisense Sequence
  source 1..20: mol_type = other RNA
tgtcgaacctcacgaacagc

SEQ ID NO: 2650 - RNA, 20 nt, synthetic construct
  misc_feature 1..20: note = Antisense Sequence
  source 1..20: mol_type = other RNA
gctgtcgaacctcacgaaca

SEQ ID NO: 2651 - RNA, 20 nt, synthetic construct
  misc_feature 1..20: note = Antisense Sequence
  source 1..20: mol_type = other RNA
cgctgtcgaacctcacgaac

SEQ ID NO: 2652 - RNA, 20 nt, synthetic construct
  misc_feature 1..20: note = Antisense Sequence
  source 1..20: mol_type = other RNA
tcgctgtcgaacctcacgaa

SEQ ID NO: 2653 - RNA, 20 nt, synthetic construct
  misc_feature 1..20: note = Antisense Sequence
  source 1..20: mol_type = other RNA
gtcgctgtcgaacctcacga

SEQ ID NO: 2654 - RNA, 20 nt, synthetic construct
  misc_feature 1..20: note = Antisense Sequence
  source 1..20: mol_type = other RNA
tctcccggtcccaatactcc

SEQ ID NO: 2655 - RNA, 20 nt, synthetic construct
  misc_feature 1..20: note = Antisense Sequence
  source 1..20: mol_type = other RNA
atctgtgtctcccggtccca

SEQ ID NO: 2656 - RNA, 20 nt, synthetic construct
  misc_feature 1..20: note = Antisense Sequence
  source 1..20: mol_type = other RNA
gtgccttggccttgcagatc

SEQ ID NO: 2657 - RNA, 20 nt, synthetic construct
  misc_feature 1..20: note = Antisense Sequence
  source 1..20: mol_type = other RNA
gtctgtgccttggccttgca

SEQ ID NO: 2658 - RNA, 20 nt, synthetic construct
  misc_feature 1..20: note = Antisense Sequence
  source 1..20: mol_type = other RNA
agtctgtgccttggccttgc

SEQ ID NO: 2659 - RNA, 20 nt, synthetic construct
  misc_feature 1..20: note = Antisense Sequence
  source 1..20: mol_type = other RNA
cagtctgtgccttggccttg

SEQ ID NO: 2660 - RNA, 20 nt, synthetic construct
  misc_feature 1..20: note = Antisense Sequence
  source 1..20: mol_type = other RNA
tcagtctgtgccttggcctt

SEQ ID NO: 2661 - RNA, 20 nt, synthetic construct
  misc_feature 1..20: note = Antisense Sequence
  source 1..20: mol_type = other RNA
gtcagtctgtgccttggcct

SEQ ID NO: 2662 - RNA, 20 nt, synthetic construct
  misc_feature 1..20: note = Antisense Sequence
  source 1..20: mol_type = other RNA
tcggtcagtctgtgccttgg

SEQ ID NO: 2663 - RNA, 20 nt, synthetic construct
  misc_feature 1..20: note = Antisense Sequence
  source 1..20: mol_type = other RNA
ctcggtcagtctgtgccttg

SEQ ID NO: 2664 - RNA, 20 nt, synthetic construct
  misc_feature 1..20: note = Antisense Sequence
  source 1..20: mol_type = other RNA
tctcggtcagtctgtgcctt

SEQ ID NO: 2665 - RNA, 20 nt, synthetic construct
  misc_feature 1..20: note = Antisense Sequence
  source 1..20: mol_type = other RNA
ctctcggtcagtctgtgcct

SEQ ID NO: 2666 - RNA, 20 nt, synthetic construct
  misc_feature 1..20: note = Antisense Sequence
  source 1..20: mol_type = other RNA
tcctctcggtcagtctgtgc

SEQ ID NO: 2667 - RNA, 20 nt, synthetic construct
  misc_feature 1..20: note = Antisense Sequence
  source 1..20: mol_type = other RNA
gtcctctcggtcagtctgtg

SEQ ID NO: 2668 - RNA, 20 nt, synthetic construct
  misc_feature 1..20: note = Antisense Sequence
  source 1..20: mol_type = other RNA
ggtcctctcggtcagtctgt

SEQ ID NO: 2669 - RNA, 20 nt, synthetic construct
  misc_feature 1..20: note = Antisense Sequence
  source 1..20: mol_type = other RNA
aggtcctctcggtcagtctg

SEQ ID NO: 2670 - RNA, 20 nt, synthetic construct
  misc_feature 1..20: note = Antisense Sequence
  source 1..20: mol_type = other RNA
caggtcctctcggtcagtct

SEQ ID NO: 2671 - RNA, 20 nt, synthetic construct
  misc_feature 1..20: note = Antisense Sequence
  source 1..20: mol_type = other RNA
tgtagtagcggagcagggtc

SEQ ID NO: 2672 - RNA, 20 nt, synthetic construct
  misc_feature 1..20: note = Antisense Sequence
  source 1..20: mol_type = other RNA
ttgtagtagcggagcagggt

SEQ ID NO: 2673 - RNA, 20 nt, synthetic construct
  misc_feature 1..20: note = Antisense Sequence
  source 1..20: mol_type = other RNA
gttgtagtagcggagcaggg

SEQ ID NO: 2674 - RNA, 20 nt, synthetic construct
  misc_feature 1..20: note = Antisense Sequence
  source 1..20: mol_type = other RNA
ggttgtagtagcggagcagg

SEQ ID NO: 2675 - RNA, 20 nt, synthetic construct
  misc_feature 1..20: note = Antisense Sequence
  source 1..20: mol_type = other RNA
tggttgtagtagcggagcag

SEQ ID NO: 2676 - RNA, 20 nt, synthetic construct
  misc_feature 1..20: note = Antisense Sequence
  source 1..20: mol_type = other RNA
ctggttgtagtagcggagca

SEQ ID NO: 2677 - RNA, 20 nt, synthetic construct
  misc_feature 1..20: note = Antisense Sequence
  source 1..20: mol_type = other RNA
attctggagggtgtgagacc

SEQ ID NO: 2678 - RNA, 20 nt, synthetic construct
  misc_feature 1..20: note = Antisense Sequence
  source 1..20: mol_type = other RNA
tattctggagggtgtgagac

SEQ ID NO: 2679 - RNA, 20 nt, synthetic construct
  misc_feature 1..20: note = Antisense Sequence
  source 1..20: mol_type = other RNA
atattctggagggtgtgaga

SEQ ID NO: 2680 - RNA, 20 nt, synthetic construct
  misc_feature 1..20: note = Antisense Sequence
  source 1..20: mol_type = other RNA
catattctggagggtgtgag

SEQ ID NO: 2681 - RNA, 20 nt, synthetic construct
  misc_feature 1..20: note = Antisense Sequence
  source 1..20: mol_type = other RNA
acatattctggagggtgtga

SEQ ID NO: 2682 - RNA, 20 nt, synthetic construct
  misc_feature 1..20: note = Antisense Sequence
  source 1..20: mol_type = other RNA
tacatattctggagggtgtg

SEQ ID NO: 2683 - RNA, 20 nt, synthetic construct
  misc_feature 1..20: note = Antisense Sequence
  source 1..20: mol_type = other RNA
atacatattctggagggtgt

SEQ ID NO: 2684 - RNA, 20 nt, synthetic construct
  misc_feature 1..20: note = Antisense Sequence
  source 1..20: mol_type = other RNA
catacatattctggagggtg

SEQ ID NO: 2685 - RNA, 20 nt, synthetic construct
  misc_feature 1..20: note = Antisense Sequence
  source 1..20: mol_type = other RNA
ccatacatattctggagggt

SEQ ID NO: 2686 - RNA, 20 nt, synthetic construct
  misc_feature 1..20: note = Antisense Sequence
  source 1..20: mol_type = other RNA
gccatacatattctggaggg

SEQ ID NO: 2687 - RNA, 20 nt, synthetic construct
  misc_feature 1..20: note = Antisense Sequence
  source 1..20: mol_type = other RNA
agccatacatattctggagg

SEQ ID NO: 2688 - RNA, 20 nt, synthetic construct
  misc_feature 1..20: note = Antisense Sequence
  source 1..20: mol_type = other RNA
cagccatacatattctggag

SEQ ID NO: 2689 - RNA, 20 nt, synthetic construct
  misc_feature 1..20: note = Antisense Sequence
  source 1..20: mol_type = other RNA
gcagccatacatattctgga

SEQ ID NO: 2690 - RNA, 20 nt, synthetic construct
  misc_feature 1..20: note = Antisense Sequence
  source 1..20: mol_type = other RNA
cgcagccatacatattctgg

SEQ ID NO: 2691 - RNA, 20 nt, synthetic construct
  misc_feature 1..20: note = Antisense Sequence
  source 1..20: mol_type = other RNA
tcgcagccatacatattctg

SEQ ID NO: 2692 - RNA, 20 nt, synthetic construct
  misc_feature 1..20: note = Antisense Sequence
  source 1..20: mol_type = other RNA
gtcgcagccatacatattct

SEQ ID NO: 2693 - RNA, 20 nt, synthetic construct
  misc_feature 1..20: note = Antisense Sequence
  source 1..20: mol_type = other RNA
cgtcgcagccatacatattc

SEQ ID NO: 2694 - RNA, 20 nt, synthetic construct
  misc_feature 1..20: note = Antisense Sequence
  source 1..20: mol_type = other RNA
acgtcgcagccatacatatt

SEQ ID NO: 2695 - RNA, 20 nt, synthetic construct
  misc_feature 1..20: note = Antisense Sequence
  source 1..20: mol_type = other RNA
cacgtcgcagccatacatat

SEQ ID NO: 2696 - RNA, 20 nt, synthetic construct
  misc_feature 1..20: note = Antisense Sequence
  source 1..20: mol_type = other RNA
ccacgtcgcagccatacata

SEQ ID NO: 2697 - RNA, 20 nt, synthetic construct
  misc_feature 1..20: note = Antisense Sequence
  source 1..20: mol_type = other RNA
tcgtaggcgtcctggtggta

SEQ ID NO: 2698 - RNA, 20 nt, synthetic construct
  misc_feature 1..20: note = Antisense Sequence
  source 1..20: mol_type = other RNA
ccacttgcgctgggtgatct

SEQ ID NO: 2699 - RNA, 20 nt, synthetic construct
  misc_feature 1..20: note = Antisense Sequence
  source 1..20: mol_type = other RNA
agtttggtcctcgccatccc

SEQ ID NO: 2700 - RNA, 20 nt, synthetic construct
  misc_feature 1..20: note = Antisense Sequence
  source 1..20: mol_type = other RNA
gagtttggtcctcgccatcc

SEQ ID NO: 2701 - RNA, 20 nt, synthetic construct
  misc_feature 1..20: note = Antisense Sequence
  source 1..20: mol_type = other RNA
tgagtttggtcctcgccatc

SEQ ID NO: 2702 - RNA, 20 nt, synthetic construct
  misc_feature 1..20: note = Antisense Sequence
  source 1..20: mol_type = other RNA
ctgagtttggtcctcgccat

SEQ ID NO: 2703 - RNA, 20 nt, synthetic construct
  misc_feature 1..20: note = Antisense Sequence
  source 1..20: mol_type = other RNA
gtcctgagtttggtcctcgc

SEQ ID NO: 2704 - RNA, 20 nt, synthetic construct
  misc_feature 1..20: note = Antisense Sequence
  source 1..20: mol_type = other RNA
tgtcctgagtttggtcctcg

SEQ ID NO: 2705 - RNA, 20 nt, synthetic construct
  misc_feature 1..20: note = Antisense Sequence
  source 1..20: mol_type = other RNA
gtgtcctgagtttggtcctc

SEQ ID NO: 2706 - RNA, 20 nt, synthetic construct
  misc_feature 1..20: note = Antisense Sequence
  source 1..20: mol_type = other RNA
agtgtcctgagtttggtcct

SEQ ID NO: 2707 - RNA, 20 nt, synthetic construct
  misc_feature 1..20: note = Antisense Sequence
  source 1..20: mol_type = other RNA
cagtgtcctgagtttggtcc

SEQ ID NO: 2708 - RNA, 20 nt, synthetic construct
  misc_feature 1..20: note = Antisense Sequence
  source 1..20: mol_type = other RNA
ggtctccacaagctcagtgt

SEQ ID NO: 2709 - RNA, 20 nt, synthetic construct
  misc_feature 1..20: note = Antisense Sequence
  source 1..20: mol_type = other RNA
ctggtctccacaagctcagt

SEQ ID NO: 2710 - RNA, 20 nt, synthetic construct
  misc_feature 1..20: note = Antisense Sequence
  source 1..20: mol_type = other RNA
tctggtctccacaagctcag

SEQ ID NO: 2711 - RNA, 20 nt, synthetic construct
  misc_feature 1..20: note = Antisense Sequence
  source 1..20: mol_type = other RNA
tggtctggtctccacaagct

SEQ ID NO: 2712 - RNA, 20 nt, synthetic construct
  misc_feature 1..20: note = Antisense Sequence
  source 1..20: mol_type = other RNA
ctggtctggtctccacaagc

SEQ ID NO: 2713 - RNA, 20 nt, synthetic construct
  misc_feature 1..20: note = Antisense Sequence
  source 1..20: mol_type = other RNA
gctggtctggtctccacaag

SEQ ID NO: 2714 - RNA, 20 nt, synthetic construct
  misc_feature 1..20: note = Antisense Sequence
  source 1..20: mol_type = other RNA
atctcctgctggtctggtct

SEQ ID NO: 2715 - RNA, 20 nt, synthetic construct
  misc_feature 1..20: note = Antisense Sequence
  source 1..20: mol_type = other RNA
tatctcctgctggtctggtc

SEQ ID NO: 2716 - RNA, 20 nt, synthetic construct
  misc_feature 1..20: note = Antisense Sequence
  source 1..20: mol_type = other RNA
ctatctcctgctggtctggt

SEQ ID NO: 2717 - RNA, 20 nt, synthetic construct
  misc_feature 1..20: note = Antisense Sequence
  source 1..20: mol_type = other RNA
tctatctcctgctggtctgg

SEQ ID NO: 2718 - RNA, 20 nt, synthetic construct
  misc_feature 1..20: note = Antisense Sequence
  source 1..20: mol_type = other RNA
ttctatctcctgctggtctg

SEQ ID NO: 2719 - RNA, 20 nt, synthetic construct
  misc_feature 1..20: note = Antisense Sequence
  source 1..20: mol_type = other RNA
aggttctatctcctgctggt

SEQ ID NO: 2720 - RNA, 20 nt, synthetic construct
  misc_feature 1..20: note = Antisense Sequence
  source 1..20: mol_type = other RNA
gaaggttctatctcctgctg

SEQ ID NO: 2721 - RNA, 20 nt, synthetic construct
  misc_feature 1..20: note = Antisense Sequence
  source 1..20: mol_type = other RNA
ggaaggttctatctcctgct

SEQ ID NO: 2722 - RNA, 20 nt, synthetic construct
  misc_feature 1..20: note = Antisense Sequence
  source 1..20: mol_type = other RNA
tggaaggttctatctcctgc

SEQ ID NO: 2723 - RNA, 20 nt, synthetic construct
  misc_feature 1..20: note = Antisense Sequence
  source 1..20: mol_type = other RNA
ctggaaggttctatctcctg

SEQ ID NO: 2724 - RNA, 20 nt, synthetic construct
  misc_feature 1..20: note = Antisense Sequence
  source 1..20: mol_type = other RNA
tctggaaggttctatctcct

SEQ ID NO: 2725 - RNA, 20 nt, synthetic construct
  misc_feature 1..20: note = Antisense Sequence
  source 1..20: mol_type = other RNA
ttctggaaggttctatctcc

SEQ ID NO: 2726 - RNA, 20 nt, synthetic construct
  misc_feature 1..20: note = Antisense Sequence
  source 1..20: mol_type = other RNA
cttctggaaggttctatctc

SEQ ID NO: 2727 - RNA, 20 nt, synthetic construct
  misc_feature 1..20: note = Antisense Sequence
  source 1..20: mol_type = other RNA
acttctggaaggttctatct

SEQ ID NO: 2728 - RNA, 20 nt, synthetic construct
  misc_feature 1..20: note = Antisense Sequence
  source 1..20: mol_type = other RNA
ggcatgtgtatctctgctct

SEQ ID NO: 2729 - RNA, 20 nt, synthetic construct
  misc_feature 1..20: note = Antisense Sequence
  source 1..20: mol_type = other RNA
aagacggctcccatctcagg

SEQ ID NO: 2730 - RNA, 20 nt, synthetic construct
  misc_feature 1..20: note = Antisense Sequence
  source 1..20: mol_type = other RNA
gaagacggctcccatctcag

SEQ ID NO: 2731 - RNA, 20 nt, synthetic construct
  misc_feature 1..20: note = Antisense Sequence
  source 1..20: mol_type = other RNA
ggaagacggctcccatctca

SEQ ID NO: 2732 - RNA, 20 nt, synthetic construct
  misc_feature 1..20: note = Antisense Sequence
  source 1..20: mol_type = other RNA
aggccagcaacaatgcccac

SEQ ID NO: 2733 - RNA, 20 nt, synthetic construct
  misc_feature 1..20: note = Antisense Sequence
  source 1..20: mol_type = other RNA
cagccaggccagcaacaatg

SEQ ID NO: 2734 - RNA, 20 nt, synthetic construct
  misc_feature 1..20: note = Antisense Sequence
  source 1..20: mol_type = other RNA
caactgctaggacagccagg

SEQ ID NO: 2735 - RNA, 20 nt, synthetic construct
  misc_feature 1..20: note = Antisense Sequence
  source 1..20: mol_type = other RNA
cacaactgctaggacagcca

SEQ ID NO: 2736 - RNA, 20 nt, synthetic construct
  misc_feature 1..20: note = Antisense Sequence
  source 1..20: mol_type = other RNA
ccacaactgctaggacagcc

SEQ ID NO: 2737 - RNA, 20 nt, synthetic construct
  misc_feature 1..20: note = Antisense Sequence
  source 1..20: mol_type = other RNA
accacaactgctaggacagc

SEQ ID NO: 2738 - RNA, 20 nt, synthetic construct
  misc_feature 1..20: note = Antisense Sequence
  source 1..20: mol_type = other RNA
gaccacaactgctaggacag

SEQ ID NO: 2739 - RNA, 20 nt, synthetic construct
  misc_feature 1..20: note = Antisense Sequence
  source 1..20: mol_type = other RNA
tgaccacaactgctaggaca

SEQ ID NO: 2740 - RNA, 20 nt, synthetic construct
  misc_feature 1..20: note = Antisense Sequence
  source 1..20: mol_type = other RNA
gatgaccacaactgctagga

SEQ ID NO: 2741 - RNA, 20 nt, synthetic construct
  misc_feature 1..20: note = Antisense Sequence
  source 1..20: mol_type = other RNA
cgatgaccacaactgctagg

SEQ ID NO: 2742 - RNA, 20 nt, synthetic construct
  misc_feature 1..20: note = Antisense Sequence
  source 1..20: mol_type = other RNA
tccgatgaccacaactgcta

SEQ ID NO: 2743 - RNA, 20 nt, synthetic construct
  misc_feature 1..20: note = Antisense Sequence
  source 1..20: mol_type = other RNA
ctccgatgaccacaactgct

SEQ ID NO: 2744 - RNA, 20 nt, synthetic construct
  misc_feature 1..20: note = Antisense Sequence
  source 1..20: mol_type = other RNA
gctccgatgaccacaactgc

SEQ ID NO: 2745 - RNA, 20 nt, synthetic construct
  misc_feature 1..20: note = Antisense Sequence
  source 1..20: mol_type = other RNA
agctccgatgaccacaactg

SEQ ID NO: 2746 - RNA, 20 nt, synthetic construct
  misc_feature 1..20: note = Antisense Sequence
  source 1..20: mol_type = other RNA
cagctccgatgaccacaact

SEQ ID NO: 2747 - RNA, 20 nt, synthetic construct
  misc_feature 1..20: note = Antisense Sequence
  source 1..20: mol_type = other RNA
acagctccgatgaccacaac

SEQ ID NO: 2748 - RNA, 20 nt, synthetic construct
  misc_feature 1..20: note = Antisense Sequence
  source 1..20: mol_type = other RNA
cacagctccgatgaccacaa

SEQ ID NO: 2749 - RNA, 20 nt, synthetic construct
  misc_feature 1..20: note = Antisense Sequence
  source 1..20: mol_type = other RNA
ccacagctccgatgaccaca

SEQ ID NO: 2750 - RNA, 20 nt, synthetic construct
  misc_feature 1..20: note = Antisense Sequence
  source 1..20: mol_type = other RNA
accacagctccgatgaccac

SEQ ID NO: 2751 - RNA, 20 nt, synthetic construct
  misc_feature 1..20: note = Antisense Sequence
  source 1..20: mol_type = other RNA
gaccacagctccgatgacca

SEQ ID NO: 2752 - RNA, 20 nt, synthetic construct
  misc_feature 1..20: note = Antisense Sequence
  source 1..20: mol_type = other RNA
agcgaccacagctccgatga

SEQ ID NO: 2753 - RNA, 20 nt, synthetic construct
  misc_feature 1..20: note = Antisense Sequence
  source 1..20: mol_type = other RNA
tcctacacatcacagcagcg

SEQ ID NO: 2754 - RNA, 20 nt, synthetic construct
  misc_feature 1..20: note = Antisense Sequence
  source 1..20: mol_type = other RNA
ctcctacacatcacagcagc

SEQ ID NO: 2755 - RNA, 20 nt, synthetic construct
  misc_feature 1..20: note = Antisense Sequence
  source 1..20: mol_type = other RNA
cctcctacacatcacagcag

SEQ ID NO: 2756 - RNA, 20 nt, synthetic construct
  misc_feature 1..20: note = Antisense Sequence
  source 1..20: mol_type = other RNA
tcctcctacacatcacagca

SEQ ID NO: 2757 - RNA, 20 nt, synthetic construct
  misc_feature 1..20: note = Antisense Sequence
  source 1..20: mol_type = other RNA
ttcctcctacacatcacagc

SEQ ID NO: 2758 - RNA, 20 nt, synthetic construct
  misc_feature 1..20: note = Antisense Sequence
  source 1..20: mol_type = other RNA
tcttcctcctacacatcaca

SEQ ID NO: 2759 - RNA, 20 nt, synthetic construct
  misc_feature 1..20: note = Antisense Sequence
  source 1..20: mol_type = other RNA
cctccttttccacctgagct

SEQ ID NO: 2760 - RNA, 20 nt, synthetic construct
  misc_feature 1..20: note = Antisense Sequence
  source 1..20: mol_type = other RNA
ccctccttttccacctgagc

SEQ ID NO: 2761 - RNA, 20 nt, synthetic construct
  misc_feature 1..20: note = Antisense Sequence
  source 1..20: mol_type = other RNA
tgcacgcagcctgagagtag

SEQ ID NO: 2762 - RNA, 20 nt, synthetic construct
  misc_feature 1..20: note = Antisense Sequence
  source 1..20: mol_type = other RNA
ctgcacgcagcctgagagta

SEQ ID NO: 2763 - RNA, 20 nt, synthetic construct
  misc_feature 1..20: note = Antisense Sequence
  source 1..20: mol_type = other RNA
tttcaagctgtgagagacac

SEQ ID NO: 2764 - RNA, 20 nt, synthetic construct
  misc_feature 1..20: note = Antisense Sequence
  source 1..20: mol_type = other RNA
accttttcaagctgtgagag

SEQ ID NO: 2765 - RNA, 20 nt, synthetic construct
  misc_feature 1..20: note = Antisense Sequence
  source 1..20: mol_type = other RNA
caccttttcaagctgtgaga

SEQ ID NO: 2766 - RNA, 20 nt, synthetic construct
  misc_feature 1..20: note = Antisense Sequence
  source 1..20: mol_type = other RNA
gaatctccattacccaggcc

SEQ ID NO: 2767 - RNA, 20 nt, synthetic construct
  misc_feature 1..20: note = Antisense Sequence
  source 1..20: mol_type = other RNA
agaatctccattacccaggc

SEQ ID NO: 2768 - RNA, 20 nt, synthetic construct
  misc_feature 1..20: note = Antisense Sequence
  source 1..20: mol_type = other RNA
aagaatctccattacccagg

SEQ ID NO: 2769 - RNA, 20 nt, synthetic construct
  misc_feature 1..20: note = Antisense Sequence
  source 1..20: mol_type = other RNA
aaagaatctccattacccag

SEQ ID NO: 2770 - RNA, 20 nt, synthetic construct
  misc_feature 1..20: note = Antisense Sequence
  source 1..20: mol_type = other RNA
caaagaatctccattaccca

SEQ ID NO: 2771 - RNA, 20 nt, synthetic construct
  misc_feature 1..20: note = Antisense Sequence
  source 1..20: mol_type = other RNA
cccaatcaaagaatctccat

SEQ ID NO: 2772 - RNA, 20 nt, synthetic construct
  misc_feature 1..20: note = Antisense Sequence
  source 1..20: mol_type = other RNA
tcccaatcaaagaatctcca

SEQ ID NO: 2773 - RNA, 20 nt, synthetic construct
  misc_feature 1..20: note = Antisense Sequence
  source 1..20: mol_type = other RNA
atcccaatcaaagaatctcc

SEQ ID NO: 2774 - RNA, 20 nt, synthetic construct
  misc_feature 1..20: note = Antisense Sequence
  source 1..20: mol_type = other RNA
catcccaatcaaagaatctc

SEQ ID NO: 2775 - RNA, 20 nt, synthetic construct
  misc_feature 1..20: note = Antisense Sequence
  source 1..20: mol_type = other RNA
cgaaacatcccaatcaaaga

SEQ ID NO: 2776 - RNA, 20 nt, synthetic construct
  misc_feature 1..20: note = Antisense Sequence
  source 1..20: mol_type = other RNA
cacgcgaaacatcccaatca

SEQ ID NO: 2777 - RNA, 20 nt, synthetic construct
  misc_feature 1..20: note = Antisense Sequence
  source 1..20: mol_type = other RNA
acacgcgaaacatcccaatc

SEQ ID NO: 2778 - RNA, 20 nt, synthetic construct
  misc_feature 1..20: note = Antisense Sequence
  source 1..20: mol_type = other RNA
cacacgcgaaacatcccaat

SEQ ID NO: 2779 - RNA, 20 nt, synthetic construct
  misc_feature 1..20: note = Antisense Sequence
  source 1..20: mol_type = other RNA
acacacgcgaaacatcccaa

SEQ ID NO: 2780 - RNA, 20 nt, synthetic construct
  misc_feature 1..20: note = Antisense Sequence
  source 1..20: mol_type = other RNA
cacacacgcgaaacatccca

SEQ ID NO: 2781 - RNA, 20 nt, synthetic construct
  misc_feature 1..20: note = Antisense Sequence
  source 1..20: mol_type = other RNA
ccacacacgcgaaacatccc

SEQ ID NO: 2782 - RNA, 20 nt, synthetic construct
  misc_feature 1..20: note = Antisense Sequence
  source 1..20: mol_type = other RNA
accacacacgcgaaacatcc

SEQ ID NO: 2783 - RNA, 20 nt, synthetic construct
  misc_feature 1..20: note = Antisense Sequence
  source 1..20: mol_type = other RNA
caccacacacgcgaaacatc

SEQ ID NO: 2784 - RNA, 20 nt, synthetic construct
  misc_feature 1..20: note = Antisense Sequence
  source 1..20: mol_type = other RNA
cccaccacacacgcgaaaca

SEQ ID NO: 2785 - RNA, 20 nt, synthetic construct
  misc_feature 1..20: note = Antisense Sequence
  source 1..20: mol_type = other RNA
agcccaccacacacgcgaaa

SEQ ID NO: 2786 - RNA, 20 nt, synthetic construct
  misc_feature 1..20: note = Antisense Sequence
  source 1..20: mol_type = other RNA
aaacagcccaccacacacgc

SEQ ID NO: 2787 - RNA, 20 nt, synthetic construct
  misc_feature 1..20: note = Antisense Sequence
  source 1..20: mol_type = other RNA
taaacagcccaccacacacg

SEQ ID NO: 2788 - RNA, 20 nt, synthetic construct
  misc_feature 1..20: note = Antisense Sequence
  source 1..20: mol_type = other RNA
tctaaacagcccaccacaca

SEQ ID NO: 2789 - RNA, 20 nt, synthetic construct
  misc_feature 1..20: note = Antisense Sequence
  source 1..20: mol_type = other RNA
gtctaaacagcccaccacac

SEQ ID NO: 2790 - RNA, 20 nt, synthetic construct
  misc_feature 1..20: note = Antisense Sequence
  source 1..20: mol_type = other RNA
agtctaaacagcccaccaca

SEQ ID NO: 2791 - RNA, 20 nt, synthetic construct
  misc_feature 1..20: note = Antisense Sequence
  source 1..20: mol_type = other RNA
cagtctaaacagcccaccac

SEQ ID NO: 2792 - RNA, 20 nt, synthetic construct
  misc_feature 1..20: note = Antisense Sequence
  source 1..20: mol_type = other RNA
acagtctaaacagcccacca

SEQ ID NO: 2793 - RNA, 20 nt, synthetic construct
  misc_feature 1..20: note = Antisense Sequence
  source 1..20: mol_type = other RNA
tgacagtctaaacagcccac

SEQ ID NO: 2794 - RNA, 20 nt, synthetic construct
  misc_feature 1..20: note = Antisense Sequence
  source 1..20: mol_type = other RNA
atgacagtctaaacagccca

SEQ ID NO: 2795 - RNA, 20 nt, synthetic construct
  misc_feature 1..20: note = Antisense Sequence
  source 1..20: mol_type = other RNA
gatgacagtctaaacagccc

SEQ ID NO: 2796 - RNA, 20 nt, synthetic construct
  misc_feature 1..20: note = Antisense Sequence
  source 1..20: mol_type = other RNA
tgatgacagtctaaacagcc

SEQ ID NO: 2797 - RNA, 20 nt, synthetic construct
  misc_feature 1..20: note = Antisense Sequence
  source 1..20: mol_type = other RNA
gtgatgacagtctaaacagc

SEQ ID NO: 2798 - RNA, 20 nt, synthetic construct
  misc_feature 1..20: note = Antisense Sequence
  source 1..20: mol_type = other RNA
agtgatgacagtctaaacag

SEQ ID NO: 2799 - RNA, 20 nt, synthetic construct
  misc_feature 1..20: note = Antisense Sequence
  source 1..20: mol_type = other RNA
atggtaagtgatgacagtct

SEQ ID NO: 2800 - RNA, 20 nt, synthetic construct
  misc_feature 1..20: note = Antisense Sequence
  source 1..20: mol_type = other RNA
catggtaagtgatgacagtc

SEQ ID NO: 2801 - RNA, 20 nt, synthetic construct
  misc_feature 1..20: note = Antisense Sequence
  source 1..20: mol_type = other RNA
gttagtcatggtaagtgatg

SEQ ID NO: 2802 - RNA, 20 nt, synthetic construct
  misc_feature 1..20: note = Antisense Sequence
  source 1..20: mol_type = other RNA
ggttagtcatggtaagtgat

SEQ ID NO: 2803 - RNA, 20 nt, synthetic construct
  misc_feature 1..20: note = Antisense Sequence
  source 1..20: mol_type = other RNA
tggttagtcatggtaagtga

SEQ ID NO: 2804 - RNA, 20 nt, synthetic construct
  misc_feature 1..20: note = Antisense Sequence
  source 1..20: mol_type = other RNA
ttctggttagtcatggtaag

SEQ ID NO: 2805 - RNA, 20 nt, synthetic construct
  misc_feature 1..20: note = Antisense Sequence
  source 1..20: mol_type = other RNA
ggcgtgaagaaatcctgcat

SEQ ID NO: 2806 - RNA, 20 nt, synthetic construct
  misc_feature 1..20: note = Antisense Sequence
  source 1..20: mol_type = other RNA
aggcgtgaagaaatcctgca

SEQ ID NO: 2807 - RNA, 20 nt, synthetic construct
  misc_feature 1..20: note = Antisense Sequence
  source 1..20: mol_type = other RNA
gaggcgtgaagaaatcctgc

SEQ ID NO: 2808 - RNA, 20 nt, synthetic construct
  misc_feature 1..20: note = Antisense Sequence
  source 1..20: mol_type = other RNA
ggaggcgtgaagaaatcctg

SEQ ID NO: 2809 - RNA, 20 nt, synthetic construct
  misc_feature 1..20: note = Antisense Sequence
  source 1..20: mol_type = other RNA
gggaggcgtgaagaaatcct

SEQ ID NO: 2810 - RNA, 20 nt, synthetic construct
  misc_feature 1..20: note = Antisense Sequence
  source 1..20: mol_type = other RNA
gacgcagacacattcaggtg

SEQ ID NO: 2811 - RNA, 20 nt, synthetic construct
  misc_feature 1..20: note = Antisense Sequence
  source 1..20: mol_type = other RNA
ggacgcagacacattcaggt

SEQ ID NO: 2812 - RNA, 20 nt, synthetic construct
  misc_feature 1..20: note = Antisense Sequence
  source 1..20: mol_type = other RNA
agggacgcagacacattcag

SEQ ID NO: 2813 - RNA, 20 nt, synthetic construct
  misc_feature 1..20: note = Antisense Sequence
  source 1..20: mol_type = other RNA
cagggacgcagacacattca

SEQ ID NO: 2814 - RNA, 20 nt, synthetic construct
  misc_feature 1..20: note = Antisense Sequence
  source 1..20: mol_type = other RNA
acagggacgcagacacattc

SEQ ID NO: 2815 - RNA, 20 nt, synthetic construct
  misc_feature 1..20: note = Antisense Sequence
  source 1..20: mol_type = other RNA
taacagggacgcagacacat

SEQ ID NO: 2816 - RNA, 20 nt, synthetic construct
  misc_feature 1..20: note = Antisense Sequence
  source 1..20: mol_type = other RNA
atgctaacagggacgcagac

SEQ ID NO: 2817 - RNA, 20 nt, synthetic construct
  misc_feature 1..20: note = Antisense Sequence
  source 1..20: mol_type = other RNA
tatgctaacagggacgcaga

SEQ ID NO: 2818 - RNA, 20 nt, synthetic construct
  misc_feature 1..20: note = Antisense Sequence
  source 1..20: mol_type = other RNA
ttatgctaacagggacgcag

SEQ ID NO: 2819 - RNA, 20 nt, synthetic construct
  misc_feature 1..20: note = Antisense Sequence
  source 1..20: mol_type = other RNA
attatgctaacagggacgca

SEQ ID NO: 2820 - RNA, 20 nt, synthetic construct
  misc_feature 1..20: note = Antisense Sequence
  source 1..20: mol_type = other RNA
cattatgctaacagggacgc

SEQ ID NO: 2821 - RNA, 20 nt, synthetic construct
  misc_feature 1..20: note = Antisense Sequence
  source 1..20: mol_type = other RNA
acattatgctaacagggacg

SEQ ID NO: 2822 - RNA, 20 nt, synthetic construct
  misc_feature 1..20: note = Antisense Sequence
  source 1..20: mol_type = other RNA
cacattatgctaacagggac

SEQ ID NO: 2823 - RNA, 20 nt, synthetic construct
  misc_feature 1..20: note = Antisense Sequence
  source 1..20: mol_type = other RNA
ggaaacacaggtcagcatgg

SEQ ID NO: 2824 - RNA, 20 nt, synthetic construct
  misc_feature 1..20: note = Antisense Sequence
  source 1..20: mol_type = other RNA
ggaggaaacacaggtcagca

SEQ ID NO: 2825 - RNA, 20 nt, synthetic construct
  misc_feature 1..20: note = Antisense Sequence
  source 1..20: mol_type = other RNA
gggaggaaacacaggtcagc

SEQ ID NO: 2826 - RNA, 20 nt, synthetic construct
  misc_feature 1..20: note = Antisense Sequence
  source 1..20: mol_type = other RNA
gaacaggaaagatgactggg

SEQ ID NO: 2827 - RNA, 20 nt, synthetic construct
  misc_feature 1..20: note = Antisense Sequence
  source 1..20: mol_type = other RNA
gcacataaagttgagacaga

SEQ ID NO: 2828 - RNA, 20 nt, synthetic construct
  misc_feature 1..20: note = Antisense Sequence
  source 1..20: mol_type = other RNA
tgcacataaagttgagacag

SEQ ID NO: 2829 - RNA, 20 nt, synthetic construct
  misc_feature 1..20: note = Antisense Sequence
  source 1..20: mol_type = other RNA
cagtagggaagtaagaagtt

SEQ ID NO: 2830 - RNA, 20 nt, synthetic construct
  misc_feature 1..20: note = Antisense Sequence
  source 1..20: mol_type = other RNA
atccatcaacctctcatagc

SEQ ID NO: 2831 - RNA, 20 nt, synthetic construct
  misc_feature 1..20: note = Antisense Sequence
  source 1..20: mol_type = other RNA
tgctctctcaaattccagga

SEQ ID NO: 2832 - RNA, 20 nt, synthetic construct
  misc_feature 1..20: note = Antisense Sequence
  source 1..20: mol_type = other RNA
tgcagattctggaaggttct

SEQ ID NO: 2833 - RNA, 20 nt, synthetic construct
  misc_feature 1..20: note = Antisense Sequence
  source 1..20: mol_type = other RNA
atgcagattctggaaggttc

SEQ ID NO: 2834 - RNA, 20 nt, synthetic construct
  misc_feature 1..20: note = Antisense Sequence
  source 1..20: mol_type = other RNA
agcgaacatgcagattctgg

SEQ ID NO: 2835 - RNA, 20 nt, synthetic construct
  misc_feature 1..20: note = Antisense Sequence
  source 1..20: mol_type = other RNA
acagcgaacatgcagattct

SEQ ID NO: 2836 - RNA, 20 nt, synthetic construct
  misc_feature 1..20: note = Antisense Sequence
  source 1..20: mol_type = other RNA
cacagcgaacatgcagattc

SEQ ID NO: 2837 - RNA, 20 nt, synthetic construct
  misc_feature 1..20: note = Antisense Sequence
  source 1..20: mol_type = other RNA
caacaccaaatgggcacagg

SEQ ID NO: 2838 - RNA, 20 nt, synthetic construct
  misc_feature 1..20: note = Antisense Sequence
  source 1..20: mol_type = other RNA
tcaacaccaaatgggcacag

SEQ ID NO: 2839 - RNA, 20 nt, synthetic construct
  misc_feature 1..20: note = Antisense Sequence
  source 1..20: mol_type = other RNA
ctcaacaccaaatgggcaca

SEQ ID NO: 2840 - RNA, 20 nt, synthetic construct
  misc_feature 1..20: note = Antisense Sequence
  source 1..20: mol_type = other RNA
ggactcaacaccaaatgggc

SEQ ID NO: 2841 - RNA, 20 nt, synthetic construct
  misc_feature 1..20: note = Antisense Sequence
  source 1..20: mol_type = other RNA
gatggactcaacaccaaatg

SEQ ID NO: 2842 - RNA, 20 nt, synthetic construct
  misc_feature 1..20: note = Antisense Sequence
  source 1..20: mol_type = other RNA
catgatggactcaacaccaa

SEQ ID NO: 2843 - RNA, 20 nt, synthetic construct
  misc_feature 1..20: note = Antisense Sequence
  source 1..20: mol_type = other RNA
ccatgatggactcaacacca

SEQ ID NO: 2844 - RNA, 20 nt, synthetic construct
  misc_feature 1..20: note = Antisense Sequence
  source 1..20: mol_type = other RNA
cccatgatggactcaacacc

SEQ ID NO: 2845 - RNA, 20 nt, synthetic construct
  misc_feature 1..20: note = Antisense Sequence
  source 1..20: mol_type = other RNA
gcccatgatggactcaacac

SEQ ID NO: 2846 - RNA, 20 nt, synthetic construct
  misc_feature 1..20: note = Antisense Sequence
  source 1..20: mol_type = other RNA
aagcccatgatggactcaac

SEQ ID NO: 2847 - RNA, 20 nt, synthetic construct
  misc_feature 1..20: note = Antisense Sequence
  source 1..20: mol_type = other RNA
aaagcccatgatggactcaa

SEQ ID NO: 2848 - RNA, 20 nt, synthetic construct
  misc_feature 1..20: note = Antisense Sequence
  source 1..20: mol_type = other RNA
ataaagcccatgatggactc

SEQ ID NO: 2849 - RNA, 20 nt, synthetic construct
  misc_feature 1..20: note = Antisense Sequence
  source 1..20: mol_type = other RNA
cataaagcccatgatggact

SEQ ID NO: 2850 - RNA, 20 nt, synthetic construct
  misc_feature 1..20: note = Antisense Sequence
  source 1..20: mol_type = other RNA
acataaagcccatgatggac

SEQ ID NO: 2851 - RNA, 20 nt, synthetic construct
  misc_feature 1..20: note = Antisense Sequence
  source 1..20: mol_type = other RNA
cacataaagcccatgatgga

SEQ ID NO: 2852 - RNA, 20 nt, synthetic construct
  misc_feature 1..20: note = Antisense Sequence
  source 1..20: mol_type = other RNA
ccacataaagcccatgatgg

SEQ ID NO: 2853 - RNA, 20 nt, synthetic construct
  misc_feature 1..20: note = Antisense Sequence
  source 1..20: mol_type = other RNA
aaccacataaagcccatgat

SEQ ID NO: 2854 - RNA, 20 nt, synthetic construct
  misc_feature 1..20: note = Antisense Sequence
  source 1..20: mol_type = other RNA
taaccacataaagcccatga

SEQ ID NO: 2855 - RNA, 20 nt, synthetic construct
  misc_feature 1..20: note = Antisense Sequence
  source 1..20: mol_type = other RNA
gactaaccacataaagccca

SEQ ID NO: 2856 - RNA, 20 nt, synthetic construct
  misc_feature 1..20: note = Antisense Sequence
  source 1..20: mol_type = other RNA
ggactaaccacataaagccc

SEQ ID NO: 2857 - RNA, 20 nt, synthetic construct
  misc_feature 1..20: note = Antisense Sequence
  source 1..20: mol_type = other RNA
aggactaaccacataaagcc

SEQ ID NO: 2858 - RNA, 20 nt, synthetic construct
  misc_feature 1..20: note = Antisense Sequence
  source 1..20: mol_type = other RNA
gaggactaaccacataaagc

SEQ ID NO: 2859 - RNA, 20 nt, synthetic construct
  misc_feature 1..20: note = Antisense Sequence
  source 1..20: mol_type = other RNA
tgaggactaaccacataaag

SEQ ID NO: 2860 - RNA, 20 nt, synthetic construct
  misc_feature 1..20: note = Antisense Sequence
  source 1..20: mol_type = other RNA
ctgaggactaaccacataaa

SEQ ID NO: 2861 - RNA, 20 nt, synthetic construct
  misc_feature 1..20: note = Antisense Sequence
  source 1..20: mol_type = other RNA
gctgaggactaaccacataa

SEQ ID NO: 2862 - RNA, 20 nt, synthetic construct
  misc_feature 1..20: note = Antisense Sequence
  source 1..20: mol_type = other RNA
agctgaggactaaccacata

SEQ ID NO: 2863 - RNA, 20 nt, synthetic construct
  misc_feature 1..20: note = Antisense Sequence
  source 1..20: mol_type = other RNA
ctcccgctggacaagtttcc

SEQ ID NO: 2864 - RNA, 20 nt, synthetic construct
  misc_feature 1..20: note = Antisense Sequence
  source 1..20: mol_type = other RNA
gctcccgctggacaagtttc

SEQ ID NO: 2865 - RNA, 20 nt, synthetic construct
  misc_feature 1..20: note = Antisense Sequence
  source 1..20: mol_type = other RNA
agctcccgctggacaagttt

SEQ ID NO: 2866 - RNA, 20 nt, synthetic construct
  misc_feature 1..20: note = Antisense Sequence
  source 1..20: mol_type = other RNA
atgtgtgagcctctgtggtc

SEQ ID NO: 2867 - RNA, 20 nt, synthetic construct
  misc_feature 1..20: note = Antisense Sequence
  source 1..20: mol_type = other RNA
gatgtgtgagcctctgtggt

SEQ ID NO: 2868 - RNA, 20 nt, synthetic construct
  misc_feature 1..20: note = Antisense Sequence
  source 1..20: mol_type = other RNA
ggcgatgtgtgagcctctgt

SEQ ID NO: 2869 - RNA, 20 nt, synthetic construct
  misc_feature 1..20: note = Antisense Sequence
  source 1..20: mol_type = other RNA
agggcgatgtgtgagcctct

SEQ ID NO: 2870 - RNA, 20 nt, synthetic construct
  misc_feature 1..20: note = Antisense Sequence
  source 1..20: mol_type = other RNA
tttgtctcagaatgcacaga

SEQ ID NO: 2871 - RNA, 20 nt, synthetic construct
  misc_feature 1..20: note = Antisense Sequence
  source 1..20: mol_type = other RNA
atttgtctcagaatgcacag

SEQ ID NO: 2872 - RNA, 20 nt, synthetic construct
  misc_feature 1..20: note = Antisense Sequence
  source 1..20: mol_type = other RNA
gaggtgaatggctctgaaaa

SEQ ID NO: 2873 - RNA, 20 nt, synthetic construct
  misc_feature 1..20: note = Antisense Sequence
  source 1..20: mol_type = other RNA
gggcaagaggtgaatggctc

SEQ ID NO: 2874 - RNA, 20 nt, synthetic construct
  misc_feature 1..20: note = Antisense Sequence
  source 1..20: mol_type = other RNA
agggcaagaggtgaatggct

SEQ ID NO: 2875 - RNA, 20 nt, synthetic construct
  misc_feature 1..20: note = Antisense Sequence
  source 1..20: mol_type = other RNA
gcagggcaagaggtgaatgg

SEQ ID NO: 2876 - RNA, 20 nt, synthetic construct
  misc_feature 1..20: note = Antisense Sequence
  source 1..20: mol_type = other RNA
tagaagcagggcaagaggtg

SEQ ID NO: 2877 - RNA, 20 nt, synthetic construct
  misc_feature 1..20: note = Antisense Sequence
  source 1..20: mol_type = other RNA
ctagaagcagggcaagaggt

SEQ ID NO: 2878 - RNA, 20 nt, synthetic construct
  misc_feature 1..20: note = Antisense Sequence
  source 1..20: mol_type = other RNA
gagcagagcagaaaaggagc

SEQ ID NO: 2879 - RNA, 20 nt, synthetic construct
  misc_feature 1..20: note = Antisense Sequence
  source 1..20: mol_type = other RNA
tcactagaaccagggcaggg

SEQ ID NO: 2880 - RNA, 20 nt, synthetic construct
  misc_feature 1..20: note = Antisense Sequence
  source 1..20: mol_type = other RNA
atcactagaaccagggcagg

SEQ ID NO: 2881 - RNA, 20 nt, synthetic construct
  misc_feature 1..20: note = Antisense Sequence
  source 1..20: mol_type = other RNA
gatcactagaaccagggcag

SEQ ID NO: 2882 - RNA, 20 nt, synthetic construct
  misc_feature 1..20: note = Antisense Sequence
  source 1..20: mol_type = other RNA
agatcactagaaccagggca

SEQ ID NO: 2883 - RNA, 20 nt, synthetic construct
  misc_feature 1..20: note = Antisense Sequence
  source 1..20: mol_type = other RNA
aagatcactagaaccagggc

SEQ ID NO: 2884 - RNA, 20 nt, synthetic construct
  misc_feature 1..20: note = Antisense Sequence
  source 1..20: mol_type = other RNA
caagatcactagaaccaggg

SEQ ID NO: 2885 - RNA, 20 nt, synthetic construct
  misc_feature 1..20: note = Antisense Sequence
  source 1..20: mol_type = other RNA
ccaagatcactagaaccagg

SEQ ID NO: 2886 - RNA, 20 nt, synthetic construct
  misc_feature 1..20: note = Antisense Sequence
  source 1..20: mol_type = other RNA
accaagatcactagaaccag

SEQ ID NO: 2887 - RNA, 20 nt, synthetic construct
  misc_feature 1..20: note = Antisense Sequence
  source 1..20: mol_type = other RNA
caccaagatcactagaacca

SEQ ID NO: 2888 - RNA, 20 nt, synthetic construct
  misc_feature 1..20: note = Antisense Sequence
  source 1..20: mol_type = other RNA
gcaccaagatcactagaacc

SEQ ID NO: 2889 - RNA, 20 nt, synthetic construct
  misc_feature 1..20: note = Antisense Sequence
  source 1..20: mol_type = other RNA
agcaccaagatcactagaac

SEQ ID NO: 2890 - RNA, 20 nt, synthetic construct
  misc_feature 1..20: note = Antisense Sequence
  source 1..20: mol_type = other RNA
cagcaccaagatcactagaa

SEQ ID NO: 2891 - RNA, 20 nt, synthetic construct
  misc_feature 1..20: note = Antisense Sequence
  source 1..20: mol_type = other RNA
attcagcaccaagatcacta

SEQ ID NO: 2892 - RNA, 20 nt, synthetic construct
  misc_feature 1..20: note = Antisense Sequence
  source 1..20: mol_type = other RNA
tgggattggattcagcacca

SEQ ID NO: 2893 - RNA, 20 nt, synthetic construct
  misc_feature 1..20: note = Antisense Sequence
  source 1..20: mol_type = other RNA
gttgggattggattcagcac

SEQ ID NO: 2894 - RNA, 20 nt, synthetic construct
  misc_feature 1..20: note = Antisense Sequence
  source 1..20: mol_type = other RNA
agttgggattggattcagca

SEQ ID NO: 2895 - RNA, 20 nt, synthetic construct
  misc_feature 1..20: note = Antisense Sequence
  source 1..20: mol_type = other RNA
gagttgggattggattcagc

SEQ ID NO: 2896 - RNA, 20 nt, synthetic construct
  misc_feature 1..20: note = Antisense Sequence
  source 1..20: mol_type = other RNA
tgagttgggattggattcag

SEQ ID NO: 2897 - RNA, 20 nt, synthetic construct
  misc_feature 1..20: note = Antisense Sequence
  source 1..20: mol_type = other RNA
atgagttgggattggattca

SEQ ID NO: 2898 - RNA, 20 nt, synthetic construct
  misc_feature 1..20: note = Antisense Sequence
  source 1..20: mol_type = other RNA
catgagttgggattggattc

SEQ ID NO: 2899 - RNA, 20 nt, synthetic construct
  misc_feature 1..20: note = Antisense Sequence
  source 1..20: mol_type = other RNA
ggtccaatttcacagacaaa

SEQ ID NO: 2900 - RNA, 20 nt, synthetic construct
  misc_feature 1..20: note = Antisense Sequence
  source 1..20: mol_type = other RNA
cgggtccaatttcacagaca

SEQ ID NO: 2901 - RNA, 20 nt, synthetic construct
  misc_feature 1..20: note = Antisense Sequence
  source 1..20: mol_type = other RNA
acgggtccaatttcacagac

SEQ ID NO: 2902 - RNA, 20 nt, synthetic construct
  misc_feature 1..20: note = Antisense Sequence
  source 1..20: mol_type = other RNA
gacgggtccaatttcacaga

SEQ ID NO: 2903 - RNA, 20 nt, synthetic construct
  misc_feature 1..20: note = Antisense Sequence
  source 1..20: mol_type = other RNA
tgacgggtccaatttcacag

SEQ ID NO: 2904 - RNA, 20 nt, synthetic construct
  misc_feature 1..20: note = Antisense Sequence
  source 1..20: mol_type = other RNA
atgacgggtccaatttcaca

SEQ ID NO: 2905 - RNA, 20 nt, synthetic construct
  misc_feature 1..20: note = Antisense Sequence
  source 1..20: mol_type = other RNA
gatgacgggtccaatttcac

SEQ ID NO: 2906 - RNA, 20 nt, synthetic construct
  misc_feature 1..20: note = Antisense Sequence
  source 1..20: mol_type = other RNA
tgatgacgggtccaatttca

SEQ ID NO: 2907 - RNA, 20 nt, synthetic construct
  misc_feature 1..20: note = Antisense Sequence
  source 1..20: mol_type = other RNA
ttgatgacgggtccaatttc

SEQ ID NO: 2908 - RNA, 20 nt, synthetic construct
  misc_feature 1..20: note = Antisense Sequence
  source 1..20: mol_type = other RNA
cttgatgacgggtccaattt

SEQ ID NO: 2909 - RNA, 20 nt, synthetic construct
  misc_feature 1..20: note = Antisense Sequence
  source 1..20: mol_type = other RNA
ccttgatgacgggtccaatt

SEQ ID NO: 2910 - RNA, 20 nt, synthetic construct
  misc_feature 1..20: note = Antisense Sequence
  source 1..20: mol_type = other RNA
tccttgatgacgggtccaat

SEQ ID NO: 2911 - RNA, 20 nt, synthetic construct
  misc_feature 1..20: note = Antisense Sequence
  source 1..20: mol_type = other RNA
gtccttgatgacgggtccaa

SEQ ID NO: 2912 - RNA, 20 nt, synthetic construct
  misc_feature 1..20: note = Antisense Sequence
  source 1..20: mol_type = other RNA
agtccttgatgacgggtcca

SEQ ID NO: 2913 - RNA, 20 nt, synthetic construct
  misc_feature 1..20: note = Antisense Sequence
  source 1..20: mol_type = other RNA
cagtccttgatgacgggtcc

SEQ ID NO: 2914 - RNA, 20 nt, synthetic construct
  misc_feature 1..20: note = Antisense Sequence
  source 1..20: mol_type = other RNA
acagtccttgatgacgggtc

SEQ ID NO: 2915 - RNA, 20 nt, synthetic construct
  misc_feature 1..20: note = Antisense Sequence
  source 1..20: mol_type = other RNA
aacagtccttgatgacgggt

SEQ ID NO: 2916 - RNA, 20 nt, synthetic construct
  misc_feature 1..20: note = Antisense Sequence
  source 1..20: mol_type = other RNA
gaacagtccttgatgacggg

SEQ ID NO: 2917 - RNA, 20 nt, synthetic construct
  misc_feature 1..20: note = Antisense Sequence
  source 1..20: mol_type = other RNA
aaagaacagtccttgatgac

SEQ ID NO: 2918 - RNA, 20 nt, synthetic construct
  misc_feature 1..20: note = Antisense Sequence
  source 1..20: mol_type = other RNA
gaaagaacagtccttgatga

SEQ ID NO: 2919 - RNA, 20 nt, synthetic construct
  misc_feature 1..20: note = Antisense Sequence
  source 1..20: mol_type = other RNA
caatcaggttctctcttcag

SEQ ID NO: 2920 - RNA, 20 nt, synthetic construct
  misc_feature 1..20: note = Antisense Sequence
  source 1..20: mol_type = other RNA
cacaatcaggttctctcttc

SEQ ID NO: 2921 - RNA, 20 nt, synthetic construct
  misc_feature 1..20: note = Antisense Sequence
  source 1..20: mol_type = other RNA
agcacacaatcaggttctct

SEQ ID NO: 2922 - RNA, 20 nt, synthetic construct
  misc_feature 1..20: note = Antisense Sequence
  source 1..20: mol_type = other RNA
gcagcacacaatcaggttct

SEQ ID NO: 2923 - RNA, 20 nt, synthetic construct
  misc_feature 1..20: note = Antisense Sequence
  source 1..20: mol_type = other RNA
tgcagcacacaatcaggttc

SEQ ID NO: 2924 - RNA, 19 nt, synthetic construct
  misc_feature 1..19: note = siRNA Sense Sequence
  source 1..19: mol_type = other RNA
agagccttgtctgcattgg

SEQ ID NO: 2925 - RNA, 19 nt, synthetic construct
  misc_feature 1..19: note = siRNA Antisense Sequence
  source 1..19: mol_type = other RNA
ccaatgcagacaaggctct

SEQ ID NO: 2926 - RNA, 19 nt, synthetic construct
  misc_feature 1..19: note = siRNA Sense Sequence
  source 1..19: mol_type = other RNA
gagccttgtctgcattggg

SEQ ID NO: 2927 - RNA, 19 nt, synthetic construct
  misc_feature 1..19: note = siRNA Antisense Sequence
  source 1..19: mol_type = other RNA
cccaatgcagacaaggctc

SEQ ID NO: 2928 - RNA, 19 nt, synthetic construct
  misc_feature 1..19: note = siRNA Sense Sequence
  source 1..19: mol_type = other RNA
ctcccacgagtttcacttc

SEQ ID NO: 2929 - RNA, 19 nt, synthetic construct
  misc_feature 1..19: note = siRNA Antisense Sequence
  source 1..19: mol_type = other RNA
gaagtgaaactcgtgggag

SEQ ID NO: 2930 - RNA, 19 nt, synthetic construct
  misc_feature 1..19: note = siRNA Sense Sequence
  source 1..19: mol_type = other RNA
tcccacgagtttcacttct

SEQ ID NO: 2931 - RNA, 19 nt, synthetic construct
  misc_feature 1..19: note = siRNA Antisense Sequence
  source 1..19: mol_type = other RNA
agaagtgaaactcgtggga

SEQ ID NO: 2932 - RNA, 19 nt, synthetic construct
  misc_feature 1..19: note = siRNA Sense Sequence
  source 1..19: mol_type = other RNA
cccacgagtttcacttctt

SEQ ID NO: 2933 - RNA, 19 nt, synthetic construct
  misc_feature 1..19: note = siRNA Antisense Sequence
  source 1..19: mol_type = other RNA
aagaagtgaaactcgtggg

SEQ ID NO: 2934 - RNA, 19 nt, synthetic construct
  misc_feature 1..19: note = siRNA Sense Sequence
  source 1..19: mol_type = other RNA
ccacgagtttcacttcttc

SEQ ID NO: 2935 - RNA, 19 nt, synthetic construct
  misc_feature 1..19: note = siRNA Antisense Sequence
  source 1..19: mol_type = other RNA
gaagaagtgaaactcgtgg

SEQ ID NO: 2936 - RNA, 19 nt, synthetic construct
  misc_feature 1..19: note = siRNA Sense Sequence
  source 1..19: mol_type = other RNA
cacgagtttcacttcttct

SEQ ID NO: 2937 - RNA, 19 nt, synthetic construct
  misc_feature 1..19: note = siRNA Antisense Sequence
  source 1..19: mol_type = other RNA
agaagaagtgaaactcgtg

SEQ ID NO: 2938 - RNA, 19 nt, synthetic construct
  misc_feature 1..19: note = siRNA Sense Sequence
  source 1..19: mol_type = other RNA
acgagtttcacttcttctc

SEQ ID NO: 2939 - RNA, 19 nt, synthetic construct
  misc_feature 1..19: note = siRNA Antisense Sequence
  source 1..19: mol_type = other RNA
gagaagaagtgaaactcgt

SEQ ID NO: 2940 - RNA, 19 nt, synthetic construct
  misc_feature 1..19: note = siRNA Sense Sequence
  source 1..19: mol_type = other RNA
cgagtttcacttcttctcc

SEQ ID NO: 2941 - RNA, 19 nt, synthetic construct
  misc_feature 1..19: note = siRNA Antisense Sequence
  source 1..19: mol_type = other RNA
ggagaagaagtgaaactcg

SEQ ID NO: 2942 - RNA, 19 nt, synthetic construct
  misc_feature 1..19: note = siRNA Sense Sequence
  source 1..19: mol_type = other RNA
gagtttcacttcttctccc

SEQ ID NO: 2943 - RNA, 19 nt, synthetic construct
  misc_feature 1..19: note = siRNA Antisense Sequence
  source 1..19: mol_type = other RNA
gggagaagaagtgaaactc

SEQ ID NO: 2944 - RNA, 19 nt, synthetic construct
  misc_feature 1..19: note = siRNA Sense Sequence
  source 1..19: mol_type = other RNA
acttcttctcccaacctat

SEQ ID NO: 2945 - RNA, 19 nt, synthetic construct
  misc_feature 1..19: note = siRNA Antisense Sequence
  source 1..19: mol_type = other RNA
ataggttgggagaagaagt

SEQ ID NO: 2946 - RNA, 19 nt, synthetic construct
  misc_feature 1..19: note = siRNA Sense Sequence
  source 1..19: mol_type = other RNA
cttcttctcccaacctatg

SEQ ID NO: 2947 - RNA, 19 nt, synthetic construct
  misc_feature 1..19: note = siRNA Antisense Sequence
  source 1..19: mol_type = other RNA
cataggttgggagaagaag

SEQ ID NO: 2948 - RNA, 19 nt, synthetic construct
  misc_feature 1..19: note = siRNA Sense Sequence
  source 1..19: mol_type = other RNA
ttctcccaacctatgtcgg

SEQ ID NO: 2949 - RNA, 19 nt, synthetic construct
  misc_feature 1..19: note = siRNA Antisense Sequence
  source 1..19: mol_type = other RNA
ccgacataggttgggagaa

SEQ ID NO: 2950 - RNA, 19 nt, synthetic construct
  misc_feature 1..19: note = siRNA Sense Sequence
  source 1..19: mol_type = other RNA
tctcccaacctatgtcggg

SEQ ID NO: 2951 - RNA, 19 nt, synthetic construct
  misc_feature 1..19: note = siRNA Antisense Sequence
  source 1..19: mol_type = other RNA
cccgacataggttgggaga

SEQ ID NO: 2952 - RNA, 19 nt, synthetic construct
  misc_feature 1..19: note = siRNA Sense Sequence
  source 1..19: mol_type = other RNA
ctcccaacctatgtcgggt

SEQ ID NO: 2953 - RNA, 19 nt, synthetic construct
  misc_feature 1..19: note = siRNA Antisense Sequence
  source 1..19: mol_type = other RNA
acccgacataggttgggag

SEQ ID NO: 2954 - RNA, 19 nt, synthetic construct
  misc_feature 1..19: note = siRNA Sense Sequence
  source 1..19: mol_type = other RNA
tcccaacctatgtcgggtc

SEQ ID NO: 2955 - RNA, 19 nt, synthetic construct
  misc_feature 1..19: note = siRNA Antisense Sequence
  source 1..19: mol_type = other RNA
gacccgacataggttggga

SEQ ID NO: 2956 - RNA, 19 nt, synthetic construct
  misc_feature 1..19: note = siRNA Sense Sequence
  source 1..19: mol_type = other RNA
aacctatgtcgggtccttc

SEQ ID NO: 2957 - RNA, 19 nt, synthetic construct
  misc_feature 1..19: note = siRNA Antisense Sequence
  source 1..19: mol_type = other RNA
gaaggacccgacataggtt

SEQ ID NO: 2958 - RNA, 19 nt, synthetic construct
  misc_feature 1..19: note = siRNA Sense Sequence
  source 1..19: mol_type = other RNA
acctatgtcgggtccttct

SEQ ID NO: 2959 - RNA, 19 nt, synthetic construct
  misc_feature 1..19: note = siRNA Antisense Sequence
  source 1..19: mol_type = other RNA
agaaggacccgacataggt

SEQ ID NO: 2960 - RNA, 19 nt, synthetic construct
  misc_feature 1..19: note = siRNA Sense Sequence
  source 1..19: mol_type = other RNA
cctatgtcgggtccttctt

SEQ ID NO: 2961 - RNA, 19 nt, synthetic construct
  misc_feature 1..19: note = siRNA Antisense Sequence
  source 1..19: mol_type = other RNA
aagaaggacccgacatagg

SEQ ID NO: 2962 - RNA, 19 nt, synthetic construct
  misc_feature 1..19: note = siRNA Sense Sequence
  source 1..19: mol_type = other RNA
ctatgtcgggtccttcttc

SEQ ID NO: 2963 - RNA, 19 nt, synthetic construct
  misc_feature 1..19: note = siRNA Antisense Sequence
  source 1..19: mol_type = other RNA
gaagaaggacccgacatag

SEQ ID NO: 2964 - RNA, 19 nt, synthetic construct
  misc_feature 1..19: note = siRNA Sense Sequence
  source 1..19: mol_type = other RNA
gtcgggtccttcttccagg

SEQ ID NO: 2965 - RNA, 19 nt, synthetic construct
  misc_feature 1..19: note = siRNA Antisense Sequence
  source 1..19: mol_type = other RNA
cctggaagaaggacccgac

SEQ ID NO: 2966 - RNA, 19 nt, synthetic construct
  misc_feature 1..19: note = siRNA Sense Sequence
  source 1..19: mol_type = other RNA
ttcttccaggatactcgtg

SEQ ID NO: 2967 - RNA, 19 nt, synthetic construct
  misc_feature 1..19: note = siRNA Antisense Sequence
  source 1..19: mol_type = other RNA
cacgagtatcctggaagaa

SEQ ID NO: 2968 - RNA, 19 nt, synthetic construct
  misc_feature 1..19: note = siRNA Sense Sequence
  source 1..19: mol_type = other RNA
tcttccaggatactcgtga

SEQ ID NO: 2969 - RNA, 19 nt, synthetic construct
  misc_feature 1..19: note = siRNA Antisense Sequence
  source 1..19: mol_type = other RNA
tcacgagtatcctggaaga

SEQ ID NO: 2970 - RNA, 19 nt, synthetic construct
  misc_feature 1..19: note = siRNA Sense Sequence
  source 1..19: mol_type = other RNA
cttccaggatactcgtgac

SEQ ID NO: 2971 - RNA, 19 nt, synthetic construct
  misc_feature 1..19: note = siRNA Antisense Sequence
  source 1..19: mol_type = other RNA
gtcacgagtatcctggaag

SEQ ID NO: 2972 - RNA, 19 nt, synthetic construct
  misc_feature 1..19: note = siRNA Sense Sequence
  source 1..19: mol_type = other RNA
ttccaggatactcgtgacg

SEQ ID NO: 2973 - RNA, 19 nt, synthetic construct
  misc_feature 1..19: note = siRNA Antisense Sequence
  source 1..19: mol_type = other RNA
cgtcacgagtatcctggaa

SEQ ID NO: 2974 - RNA, 19 nt, synthetic construct
  misc_feature 1..19: note = siRNA Sense Sequence
  source 1..19: mol_type = other RNA
tccaggatactcgtgacgc

SEQ ID NO: 2975 - RNA, 19 nt, synthetic construct
  misc_feature 1..19: note = siRNA Antisense Sequence
  source 1..19: mol_type = other RNA
gcgtcacgagtatcctgga

SEQ ID NO: 2976 - RNA, 19 nt, synthetic construct
  misc_feature 1..19: note = siRNA Sense Sequence
  source 1..19: mol_type = other RNA
ccaggatactcgtgacgcg

SEQ ID NO: 2977 - RNA, 19 nt, synthetic construct
  misc_feature 1..19: note = siRNA Antisense Sequence
  source 1..19: mol_type = other RNA
cgcgtcacgagtatcctgg

SEQ ID NO: 2978 - RNA, 19 nt, synthetic construct
  misc_feature 1..19: note = siRNA Sense Sequence
  source 1..19: mol_type = other RNA
caggatactcgtgacgcgt

SEQ ID NO: 2979 - RNA, 19 nt, synthetic construct
  misc_feature 1..19: note = siRNA Antisense Sequence
  source 1..19: mol_type = other RNA
acgcgtcacgagtatcctg

SEQ ID NO: 2980 - RNA, 19 nt, synthetic construct
  misc_feature 1..19: note = siRNA Sense Sequence
  source 1..19: mol_type = other RNA
aggatactcgtgacgcgtc

SEQ ID NO: 2981 - RNA, 19 nt, synthetic construct
  misc_feature 1..19: note = siRNA Antisense Sequence
  source 1..19: mol_type = other RNA
gacgcgtcacgagtatcct

SEQ ID NO: 2982 - RNA, 19 nt, synthetic construct
  misc_feature 1..19: note = siRNA Sense Sequence
  source 1..19: mol_type = other RNA
ggatactcgtgacgcgtcc

SEQ ID NO: 2983 - RNA, 19 nt, synthetic construct
  misc_feature 1..19: note = siRNA Antisense Sequence
  source 1..19: mol_type = other RNA
ggacgcgtcacgagtatcc

SEQ ID NO: 2984 - RNA, 19 nt, synthetic construct
  misc_feature 1..19: note = siRNA Sense Sequence
  source 1..19: mol_type = other RNA
ccatttcccactcccattg

SEQ ID NO: 2985 - RNA, 19 nt, synthetic construct
  misc_feature 1..19: note = siRNA Antisense Sequence
  source 1..19: mol_type = other RNA
caatgggagtgggaaatgg

SEQ ID NO: 2986 - RNA, 19 nt, synthetic construct
  misc_feature 1..19: note = siRNA Sense Sequence
  source 1..19: mol_type = other RNA
catttcccactcccattgg

SEQ ID NO: 2987 - RNA, 19 nt, synthetic construct
  misc_feature 1..19: note = siRNA Antisense Sequence
  source 1..19: mol_type = other RNA
ccaatgggagtgggaaatg

SEQ ID NO: 2988 - RNA, 19 nt, synthetic construct
  misc_feature 1..19: note = siRNA Sense Sequence
  source 1..19: mol_type = other RNA
ccactcccattgggtgtcg

SEQ ID NO: 2989 - RNA, 19 nt, synthetic construct
  misc_feature 1..19: note = siRNA Antisense Sequence
  source 1..19: mol_type = other RNA
cgacacccaatgggagtgg

SEQ ID NO: 2990 - RNA, 19 nt, synthetic construct
  misc_feature 1..19: note = siRNA Sense Sequence
  source 1..19: mol_type = other RNA
tcccattgggtgtcgggtg

SEQ ID NO: 2991 - RNA, 19 nt, synthetic construct
  misc_feature 1..19: note = siRNA Antisense Sequence
  source 1..19: mol_type = other RNA
cacccgacacccaatggga

SEQ ID NO: 2992 - RNA, 19 nt, synthetic construct
  misc_feature 1..19: note = siRNA Sense Sequence
  source 1..19: mol_type = other RNA
cccattgggtgtcgggtgt

SEQ ID NO: 2993 - RNA, 19 nt, synthetic construct
  misc_feature 1..19: note = siRNA Antisense Sequence
  source 1..19: mol_type = other RNA
acacccgacacccaatggg

SEQ ID NO: 2994 - RNA, 19 nt, synthetic construct
  misc_feature 1..19: note = siRNA Sense Sequence
  source 1..19: mol_type = other RNA
ccattgggtgtcgggtgtc

SEQ ID NO: 2995 - RNA, 19 nt, synthetic construct
  misc_feature 1..19: note = siRNA Antisense Sequence
  source 1..19: mol_type = other RNA
gacacccgacacccaatgg

SEQ ID NO: 2996 - RNA, 19 nt, synthetic construct
  misc_feature 1..19: note = siRNA Sense Sequence
  source 1..19: mol_type = other RNA
cattgggtgtcgggtgtct

SEQ ID NO: 2997 - RNA, 19 nt, synthetic construct
  misc_feature 1..19: note = siRNA Antisense Sequence
  source 1..19: mol_type = other RNA
agacacccgacacccaatg

SEQ ID NO: 2998 - RNA, 19 nt, synthetic construct
  misc_feature 1..19: note = siRNA Sense Sequence
  source 1..19: mol_type = other RNA
attgggtgtcgggtgtcta

SEQ ID NO: 2999 - RNA, 19 nt, synthetic construct
  misc_feature 1..19: note = siRNA Antisense Sequence
  source 1..19: mol_type = other RNA
tagacacccgacacccaat

SEQ ID NO: 3000 - RNA, 19 nt, synthetic construct
  misc_feature 1..19: note = siRNA Sense Sequence
  source 1..19: mol_type = other RNA
ttgggtgtcgggtgtctag

SEQ ID NO: 3001 - RNA, 19 nt, synthetic construct
  misc_feature 1..19: note = siRNA Antisense Sequence
  source 1..19: mol_type = other RNA
ctagacacccgacacccaa

SEQ ID NO: 3002 - RNA, 19 nt, synthetic construct
  misc_feature 1..19: note = siRNA Sense Sequence
  source 1..19: mol_type = other RNA
tgggtgtcgggtgtctaga

SEQ ID NO: 3003 - RNA, 19 nt, synthetic construct
  misc_feature 1..19: note = siRNA Antisense Sequence
  source 1..19: mol_type = other RNA
tctagacacccgacaccca

SEQ ID NO: 3004 - RNA, 19 nt, synthetic construct
  misc_feature 1..19: note = siRNA Sense Sequence
  source 1..19: mol_type = other RNA
gggtgtcgggtgtctagag

SEQ ID NO: 3005 - RNA, 19 nt, synthetic construct
  misc_feature 1..19: note = siRNA Antisense Sequence
  source 1..19: mol_type = other RNA
ctctagacacccgacaccc

SEQ ID NO: 3006 - RNA, 19 nt, synthetic construct
  misc_feature 1..19: note = siRNA Sense Sequence
  source 1..19: mol_type = other RNA
agaagccaatcagtgtcgc

SEQ ID NO: 3007 - RNA, 19 nt, synthetic construct
  misc_feature 1..19: note = siRNA Antisense Sequence
  source 1..19: mol_type = other RNA
gcgacactgattggcttct

SEQ ID NO: 3008 - RNA, 19 nt, synthetic construct
  misc_feature 1..19: note = siRNA Sense Sequence
  source 1..19: mol_type = other RNA
gaagccaatcagtgtcgcc

SEQ ID NO: 3009 - RNA, 19 nt, synthetic construct
  misc_feature 1..19: note = siRNA Antisense Sequence
  source 1..19: mol_type = other RNA
ggcgacactgattggcttc

SEQ ID NO: 3010 - RNA, 19 nt, synthetic construct
  misc_feature 1..19: note = siRNA Sense Sequence
  source 1..19: mol_type = other RNA
aagccaatcagtgtcgccg

SEQ ID NO: 3011 - RNA, 19 nt, synthetic construct
  misc_feature 1..19: note = siRNA Antisense Sequence
  source 1..19: mol_type = other RNA
cggcgacactgattggctt

SEQ ID NO: 3012 - RNA, 19 nt, synthetic construct
  misc_feature 1..19: note = siRNA Sense Sequence
  source 1..19: mol_type = other RNA
gggtcccagttctaaagtc

SEQ ID NO: 3013 - RNA, 19 nt, synthetic construct
  misc_feature 1..19: note = siRNA Antisense Sequence
  source 1..19: mol_type = other RNA
gactttagaactgggaccc

SEQ ID NO: 3014 - RNA, 19 nt, synthetic construct
  misc_feature 1..19: note = siRNA Sense Sequence
  source 1..19: mol_type = other RNA
ggtcccagttctaaagtcc

SEQ ID NO: 3015 - RNA, 19 nt, synthetic construct
  misc_feature 1..19: note = siRNA Antisense Sequence
  source 1..19: mol_type = other RNA
ggactttagaactgggacc

SEQ ID NO: 3016 - RNA, 19 nt, synthetic construct
  misc_feature 1..19: note = siRNA Sense Sequence
  source 1..19: mol_type = other RNA
gtcccagttctaaagtccc

SEQ ID NO: 3017 - RNA, 19 nt, synthetic construct
  misc_feature 1..19: note = siRNA Antisense Sequence
  source 1..19: mol_type = other RNA
gggactttagaactgggac

SEQ ID NO: 3018 - RNA, 19 nt, synthetic construct
  misc_feature 1..19: note = siRNA Sense Sequence
  source 1..19: mol_type = other RNA
acccacccggactcagaat

SEQ ID NO: 3019 - RNA, 19 nt, synthetic construct
  misc_feature 1..19: note = siRNA Antisense Sequence
  source 1..19: mol_type = other RNA
attctgagtccgggtgggt

SEQ ID NO: 3020 - RNA, 19 nt, synthetic construct
  misc_feature 1..19: note = siRNA Sense Sequence
  source 1..19: mol_type = other RNA
cccacccggactcagaatc

SEQ ID NO: 3021 - RNA, 19 nt, synthetic construct
  misc_feature 1..19: note = siRNA Antisense Sequence
  source 1..19: mol_type = other RNA
gattctgagtccgggtggg

SEQ ID NO: 3022 - RNA, 19 nt, synthetic construct
  misc_feature 1..19: note = siRNA Sense Sequence
  source 1..19: mol_type = other RNA
ccacccggactcagaatct

SEQ ID NO: 3023 - RNA, 19 nt, synthetic construct
  misc_feature 1..19: note = siRNA Antisense Sequence
  source 1..19: mol_type = other RNA
agattctgagtccgggtgg

SEQ ID NO: 3024 - RNA, 19 nt, synthetic construct
  misc_feature 1..19: note = siRNA Sense Sequence
  source 1..19: mol_type = other RNA
cacccggactcagaatctc

SEQ ID NO: 3025 - RNA, 19 nt, synthetic construct
  misc_feature 1..19: note = siRNA Antisense Sequence
  source 1..19: mol_type = other RNA
gagattctgagtccgggtg

SEQ ID NO: 3026 - RNA, 19 nt, synthetic construct
  misc_feature 1..19: note = siRNA Sense Sequence
  source 1..19: mol_type = other RNA
acccggactcagaatctcc

SEQ ID NO: 3027 - RNA, 19 nt, synthetic construct
  misc_feature 1..19: note = siRNA Antisense Sequence
  source 1..19: mol_type = other RNA
ggagattctgagtccgggt

SEQ ID NO: 3028 - RNA, 19 nt, synthetic construct
  misc_feature 1..19: note = siRNA Sense Sequence
  source 1..19: mol_type = other RNA
cccggactcagaatctcct

SEQ ID NO: 3029 - RNA, 19 nt, synthetic construct
  misc_feature 1..19: note = siRNA Antisense Sequence
  source 1..19: mol_type = other RNA
aggagattctgagtccggg

SEQ ID NO: 3030 - RNA, 19 nt, synthetic construct
  misc_feature 1..19: note = siRNA Sense Sequence
  source 1..19: mol_type = other RNA
ccggactcagaatctcctc

SEQ ID NO: 3031 - RNA, 19 nt, synthetic construct
  misc_feature 1..19: note = siRNA Antisense Sequence
  source 1..19: mol_type = other RNA
gaggagattctgagtccgg

SEQ ID NO: 3032 - RNA, 19 nt, synthetic construct
  misc_feature 1..19: note = siRNA Sense Sequence
  source 1..19: mol_type = other RNA
actcagaatctcctcagac

SEQ ID NO: 3033 - RNA, 19 nt, synthetic construct
  misc_feature 1..19: note = siRNA Antisense Sequence
  source 1..19: mol_type = other RNA
gtctgaggagattctgagt

SEQ ID NO: 3034 - RNA, 19 nt, synthetic construct
  misc_feature 1..19: note = siRNA Sense Sequence
  source 1..19: mol_type = other RNA
ctcagaatctcctcagacg

SEQ ID NO: 3035 - RNA, 19 nt, synthetic construct
  misc_feature 1..19: note = siRNA Antisense Sequence
  source 1..19: mol_type = other RNA
cgtctgaggagattctgag

SEQ ID NO: 3036 - RNA, 19 nt, synthetic construct
  misc_feature 1..19: note = siRNA Sense Sequence
  source 1..19: mol_type = other RNA
tcagaatctcctcagacgc

SEQ ID NO: 3037 - RNA, 19 nt, synthetic construct
  misc_feature 1..19: note = siRNA Antisense Sequence
  source 1..19: mol_type = other RNA
gcgtctgaggagattctga

SEQ ID NO: 3038 - RNA, 19 nt, synthetic construct
  misc_feature 1..19: note = siRNA Sense Sequence
  source 1..19: mol_type = other RNA
cagaatctcctcagacgcc

SEQ ID NO: 3039 - RNA, 19 nt, synthetic construct
  misc_feature 1..19: note = siRNA Antisense Sequence
  source 1..19: mol_type = other RNA
ggcgtctgaggagattctg

SEQ ID NO: 3040 - RNA, 19 nt, synthetic construct
  misc_feature 1..19: note = siRNA Sense Sequence
  source 1..19: mol_type = other RNA
agaatctcctcagacgccg

SEQ ID NO: 3041 - RNA, 19 nt, synthetic construct
  misc_feature 1..19: note = siRNA Antisense Sequence
  source 1..19: mol_type = other RNA
cggcgtctgaggagattct

SEQ ID NO: 3042 - RNA, 19 nt, synthetic construct
  misc_feature 1..19: note = siRNA Sense Sequence
  source 1..19: mol_type = other RNA
gaatctcctcagacgccga

SEQ ID NO: 3043 - RNA, 19 nt, synthetic construct
  misc_feature 1..19: note = siRNA Antisense Sequence
  source 1..19: mol_type = other RNA
tcggcgtctgaggagattc

SEQ ID NO: 3044 - RNA, 19 nt, synthetic construct
  misc_feature 1..19: note = siRNA Sense Sequence
  source 1..19: mol_type = other RNA
aatctcctcagacgccgag

SEQ ID NO: 3045 - RNA, 19 nt, synthetic construct
  misc_feature 1..19: note = siRNA Antisense Sequence
  source 1..19: mol_type = other RNA
ctcggcgtctgaggagatt

SEQ ID NO: 3046 - RNA, 19 nt, synthetic construct
  misc_feature 1..19: note = siRNA Sense Sequence
  source 1..19: mol_type = other RNA
tggctcccactccatgagg

SEQ ID NO: 3047 - RNA, 19 nt, synthetic construct
  misc_feature 1..19: note = siRNA Antisense Sequence
  source 1..19: mol_type = other RNA
cctcatggagtgggagcca

SEQ ID NO: 3048 - RNA, 19 nt, synthetic construct
  misc_feature 1..19: note = siRNA Sense Sequence
  source 1..19: mol_type = other RNA
ctccatgaggtatttccac

SEQ ID NO: 3049 - RNA, 19 nt, synthetic construct
  misc_feature 1..19: note = siRNA Antisense Sequence
  source 1..19: mol_type = other RNA
gtggaaatacctcatggag

SEQ ID NO: 3050 - RNA, 19 nt, synthetic construct
  misc_feature 1..19: note = siRNA Sense Sequence
  source 1..19: mol_type = other RNA
tccatgaggtatttccaca

SEQ ID NO: 3051 - RNA, 19 nt, synthetic construct
  misc_feature 1..19: note = siRNA Antisense Sequence
  source 1..19: mol_type = other RNA
tgtggaaatacctcatgga

SEQ ID NO: 3052 - RNA, 19 nt, synthetic construct
  misc_feature 1..19: note = siRNA Sense Sequence
  source 1..19: mol_type = other RNA
ccatgaggtatttccacac

SEQ ID NO: 3053 - RNA, 19 nt, synthetic construct
  misc_feature 1..19: note = siRNA Antisense Sequence
  source 1..19: mol_type = other RNA
gtgtggaaatacctcatgg

SEQ ID NO: 3054 - RNA, 19 nt, synthetic construct
  misc_feature 1..19: note = siRNA Sense Sequence
  source 1..19: mol_type = other RNA
ggtatttccacacctccgt

SEQ ID NO: 3055 - RNA, 19 nt, synthetic construct
  misc_feature 1..19: note = siRNA Antisense Sequence
  source 1..19: mol_type = other RNA
acggaggtgtggaaatacc

SEQ ID NO: 3056 - RNA, 19 nt, synthetic construct
  misc_feature 1..19: note = siRNA Sense Sequence
  source 1..19: mol_type = other RNA
gtatttccacacctccgtg

SEQ ID NO: 3057 - RNA, 19 nt, synthetic construct
  misc_feature 1..19: note = siRNA Antisense Sequence
  source 1..19: mol_type = other RNA
cacggaggtgtggaaatac

SEQ ID NO: 3058 - RNA, 19 nt, synthetic construct
  misc_feature 1..19: note = siRNA Sense Sequence
  source 1..19: mol_type = other RNA
cgcttcatcaccgtgggct

SEQ ID NO: 3059 - RNA, 19 nt, synthetic construct
  misc_feature 1..19: note = siRNA Antisense Sequence
  source 1..19: mol_type = other RNA
agcccacggtgatgaagcg

SEQ ID NO: 3060 - RNA, 19 nt, synthetic construct
  misc_feature 1..19: note = siRNA Sense Sequence
  source 1..19: mol_type = other RNA
gcttcatcaccgtgggcta

SEQ ID NO: 3061 - RNA, 19 nt, synthetic construct
  misc_feature 1..19: note = siRNA Antisense Sequence
  source 1..19: mol_type = other RNA
tagcccacggtgatgaagc

SEQ ID NO: 3062 - RNA, 19 nt, synthetic construct
  misc_feature 1..19: note = siRNA Sense Sequence
  source 1..19: mol_type = other RNA
cttcatcaccgtgggctac

SEQ ID NO: 3063 - RNA, 19 nt, synthetic construct
  misc_feature 1..19: note = siRNA Antisense Sequence
  source 1..19: mol_type = other RNA
gtagcccacggtgatgaag

SEQ ID NO: 3064 - RNA, 19 nt, synthetic construct
  misc_feature 1..19: note = siRNA Sense Sequence
  source 1..19: mol_type = other RNA
ttcatcaccgtgggctacg

SEQ ID NO: 3065 - RNA, 19 nt, synthetic construct
  misc_feature 1..19: note = siRNA Antisense Sequence
  source 1..19: mol_type = other RNA
cgtagcccacggtgatgaa

SEQ ID NO: 3066 - RNA, 19 nt, synthetic construct
  misc_feature 1..19: note = siRNA Sense Sequence
  source 1..19: mol_type = other RNA
tcaccgtgggctacgtgga

SEQ ID NO: 3067 - RNA, 19 nt, synthetic construct
  misc_feature 1..19: note = siRNA Antisense Sequence
  source 1..19: mol_type = other RNA
tccacgtagcccacggtga

SEQ ID NO: 3068 - RNA, 19 nt, synthetic construct
  misc_feature 1..19: note = siRNA Sense Sequence
  source 1..19: mol_type = other RNA
gtggacgacacgctgttcg

SEQ ID NO: 3069 - RNA, 19 nt, synthetic construct
  misc_feature 1..19: note = siRNA Antisense Sequence
  source 1..19: mol_type = other RNA
cgaacagcgtgtcgtccac

SEQ ID NO: 3070 - RNA, 19 nt, synthetic construct
  misc_feature 1..19: note = siRNA Sense Sequence
  source 1..19: mol_type = other RNA
acgctgttcgtgaggttcg

SEQ ID NO: 3071 - RNA, 19 nt, synthetic construct
  misc_feature 1..19: note = siRNA Antisense Sequence
  source 1..19: mol_type = other RNA
cgaacctcacgaacagcgt

SEQ ID NO: 3072 - RNA, 19 nt, synthetic construct
  misc_feature 1..19: note = siRNA Sense Sequence
  source 1..19: mol_type = other RNA
cgctgttcgtgaggttcga

SEQ ID NO: 3073 - RNA, 19 nt, synthetic construct
  misc_feature 1..19: note = siRNA Antisense Sequence
  source 1..19: mol_type = other RNA
tcgaacctcacgaacagcg

SEQ ID NO: 3074 - RNA, 19 nt, synthetic construct
  misc_feature 1..19: note = siRNA Sense Sequence
  source 1..19: mol_type = other RNA
gctgttcgtgaggttcgac

SEQ ID NO: 3075 - RNA, 19 nt, synthetic construct
  misc_feature 1..19: note = siRNA Antisense Sequence
  source 1..19: mol_type = other RNA
gtcgaacctcacgaacagc

SEQ ID NO: 3076 - RNA, 19 nt, synthetic construct
  misc_feature 1..19: note = siRNA Sense Sequence
  source 1..19: mol_type = other RNA
ctgttcgtgaggttcgaca

SEQ ID NO: 3077 - RNA, 19 nt, synthetic construct
  misc_feature 1..19: note = siRNA Antisense Sequence
  source 1..19: mol_type = other RNA
tgtcgaacctcacgaacag

SEQ ID NO: 3078 - RNA, 19 nt, synthetic construct
  misc_feature 1..19: note = siRNA Sense Sequence
  source 1..19: mol_type = other RNA
tgttcgtgaggttcgacag

SEQ ID NO: 3079 - RNA, 19 nt, synthetic construct
  misc_feature 1..19: note = siRNA Antisense Sequence
  source 1..19: mol_type = other RNA
ctgtcgaacctcacgaaca

SEQ ID NO: 3080 - RNA, 19 nt, synthetic construct
  misc_feature 1..19: note = siRNA Sense Sequence
  source 1..19: mol_type = other RNA
gttcgtgaggttcgacagc

SEQ ID NO: 3081 - RNA, 19 nt, synthetic construct
  misc_feature 1..19: note = siRNA Antisense Sequence
  source 1..19: mol_type = other RNA
gctgtcgaacctcacgaac

SEQ ID NO: 3082 - RNA, 19 nt, synthetic construct
  misc_feature 1..19: note = siRNA Sense Sequence
  source 1..19: mol_type = other RNA
ttcgtgaggttcgacagcg

SEQ ID NO: 3083 - RNA, 19 nt, synthetic construct
  misc_feature 1..19: note = siRNA Antisense Sequence
  source 1..19: mol_type = other RNA
cgctgtcgaacctcacgaa

SEQ ID NO: 3084 - RNA, 19 nt, synthetic construct
  misc_feature 1..19: note = siRNA Sense Sequence
  source 1..19: mol_type = other RNA
tcgtgaggttcgacagcga

SEQ ID NO: 3085 - RNA, 19 nt, synthetic construct
  misc_feature 1..19: note = siRNA Antisense Sequence
  source 1..19: mol_type = other RNA
tcgctgtcgaacctcacga

SEQ ID NO: 3086 - RNA, 19 nt, synthetic construct
  misc_feature 1..19: note = siRNA Sense Sequence
  source 1..19: mol_type = other RNA
cgtgaggttcgacagcgac

SEQ ID NO: 3087 - RNA, 19 nt, synthetic construct
  misc_feature 1..19: note = siRNA Antisense Sequence
  source 1..19: mol_type = other RNA
gtcgctgtcgaacctcacg

SEQ ID NO: 3088 - RNA, 19 nt, synthetic construct
  misc_feature 1..19: note = siRNA Sense Sequence
  source 1..19: mol_type = other RNA
gtgaggttcgacagcgacg

SEQ ID NO: 3089 - RNA, 19 nt, synthetic construct
  misc_feature 1..19: note = siRNA Antisense Sequence
  source 1..19: mol_type = other RNA
cgtcgctgtcgaacctcac

SEQ ID NO: 3090 - RNA, 19 nt, synthetic construct
  misc_feature 1..19: note = siRNA Sense Sequence
  source 1..19: mol_type = other RNA
cgtggatagagcaggaggg

SEQ ID NO: 3091 - RNA, 19 nt, synthetic construct
  misc_feature 1..19: note = siRNA Antisense Sequence
  source 1..19: mol_type = other RNA
ccctcctgctctatccacg

SEQ ID NO: 3092 - RNA, 19 nt, synthetic construct
  misc_feature 1..19: note = siRNA Sense Sequence
  source 1..19: mol_type = other RNA
cggagtattgggaccggga

SEQ ID NO: 3093 - RNA, 19 nt, synthetic construct
  misc_feature 1..19: note = siRNA Antisense Sequence
  source 1..19: mol_type = other RNA
tcccggtcccaatactccg

SEQ ID NO: 3094 - RNA, 19 nt, synthetic construct
  misc_feature 1..19: note = siRNA Sense Sequence
  source 1..19: mol_type = other RNA
ggagtattgggaccgggag

SEQ ID NO: 3095 - RNA, 19 nt, synthetic construct
  misc_feature 1..19: note = siRNA Antisense Sequence
  source 1..19: mol_type = other RNA
ctcccggtcccaatactcc

SEQ ID NO: 3096 - RNA, 19 nt, synthetic construct
  misc_feature 1..19: note = siRNA Sense Sequence
  source 1..19: mol_type = other RNA
acagatctgcaaggccaag

SEQ ID NO: 3097 - RNA, 19 nt, synthetic construct
  misc_feature 1..19: note = siRNA Antisense Sequence
  source 1..19: mol_type = other RNA
cttggccttgcagatctgt

SEQ ID NO: 3098 - RNA, 19 nt, synthetic construct
  misc_feature 1..19: note = siRNA Sense Sequence
  source 1..19: mol_type = other RNA
atctgcaaggccaaggcac

SEQ ID NO: 3099 - RNA, 19 nt, synthetic construct
  misc_feature 1..19: note = siRNA Antisense Sequence
  source 1..19: mol_type = other RNA
gtgccttggccttgcagat

SEQ ID NO: 3100 - RNA, 19 nt, synthetic construct
  misc_feature 1..19: note = siRNA Sense Sequence
  source 1..19: mol_type = other RNA
tctgcaaggccaaggcaca

SEQ ID NO: 3101 - RNA, 19 nt, synthetic construct
  misc_feature 1..19: note = siRNA Antisense Sequence
  source 1..19: mol_type = other RNA
tgtgccttggccttgcaga

SEQ ID NO: 3102 - RNA, 19 nt, synthetic construct
  misc_feature 1..19: note = siRNA Sense Sequence
  source 1..19: mol_type = other RNA
ctgcaaggccaaggcacag

SEQ ID NO: 3103 - RNA, 19 nt, synthetic construct
  misc_feature 1..19: note = siRNA Antisense Sequence
  source 1..19: mol_type = other RNA
ctgtgccttggccttgcag

SEQ ID NO: 3104 - RNA, 19 nt, synthetic construct
  misc_feature 1..19: note = siRNA Sense Sequence
  source 1..19: mol_type = other RNA
tgcaaggccaaggcacaga

SEQ ID NO: 3105 - RNA, 19 nt, synthetic construct
  misc_feature 1..19: note = siRNA Antisense Sequence
  source 1..19: mol_type = other RNA
tctgtgccttggccttgca

SEQ ID NO: 3106 - RNA, 19 nt, synthetic construct
  misc_feature 1..19: note = siRNA Sense Sequence
  source 1..19: mol_type = other RNA
gcaaggccaaggcacagac

SEQ ID NO: 3107 - RNA, 19 nt, synthetic construct
  misc_feature 1..19: note = siRNA Antisense Sequence
  source 1..19: mol_type = other RNA
gtctgtgccttggccttgc

SEQ ID NO: 3108 - RNA, 19 nt, synthetic construct
  misc_feature 1..19: note = siRNA Sense Sequence
  source 1..19: mol_type = other RNA
caaggccaaggcacagact

SEQ ID NO: 3109 - RNA, 19 nt, synthetic construct
  misc_feature 1..19: note = siRNA Antisense Sequence
  source 1..19: mol_type = other RNA
agtctgtgccttggccttg

SEQ ID NO: 3110 - RNA, 19 nt, synthetic construct
  misc_feature 1..19: note = siRNA Sense Sequence
  source 1..19: mol_type = other RNA
aaggcacagactgaccgag

SEQ ID NO: 3111 - RNA, 19 nt, synthetic construct
  misc_feature 1..19: note = siRNA Antisense Sequence
  source 1..19: mol_type = other RNA
ctcggtcagtctgtgcctt

SEQ ID NO: 3112 - RNA, 19 nt, synthetic construct
  misc_feature 1..19: note = siRNA Sense Sequence
  source 1..19: mol_type = other RNA
ggaccctgctccgctacta

SEQ ID NO: 3113 - RNA, 19 nt, synthetic construct
  misc_feature 1..19: note = siRNA Antisense Sequence
  source 1..19: mol_type = other RNA
tagtagcggagcagggtcc

SEQ ID NO: 3114 - RNA, 19 nt, synthetic construct
  misc_feature 1..19: note = siRNA Sense Sequence
  source 1..19: mol_type = other RNA
gaccctgctccgctactac

SEQ ID NO: 3115 - RNA, 19 nt, synthetic construct
  misc_feature 1..19: note = siRNA Antisense Sequence
  source 1..19: mol_type = other RNA
gtagtagcggagcagggtc

SEQ ID NO: 3116 - RNA, 19 nt, synthetic construct
  misc_feature 1..19: note = siRNA Sense Sequence
  source 1..19: mol_type = other RNA
accctgctccgctactaca

SEQ ID NO: 3117 - RNA, 19 nt, synthetic construct
  misc_feature 1..19: note = siRNA Antisense Sequence
  source 1..19: mol_type = other RNA
tgtagtagcggagcagggt

SEQ ID NO: 3118 - RNA, 19 nt, synthetic construct
  misc_feature 1..19: note = siRNA Sense Sequence
  source 1..19: mol_type = other RNA
ggtctcacaccctccagaa

SEQ ID NO: 3119 - RNA, 19 nt, synthetic construct
  misc_feature 1..19: note = siRNA Antisense Sequence
  source 1..19: mol_type = other RNA
ttctggagggtgtgagacc

SEQ ID NO: 3120 - RNA, 19 nt, synthetic construct
  misc_feature 1..19: note = siRNA Sense Sequence
  source 1..19: mol_type = other RNA
gtctcacaccctccagaat

SEQ ID NO: 3121 - RNA, 19 nt, synthetic construct
  misc_feature 1..19: note = siRNA Antisense Sequence
  source 1..19: mol_type = other RNA
attctggagggtgtgagac

SEQ ID NO: 3122 - RNA, 19 nt, synthetic construct
  misc_feature 1..19: note = siRNA Sense Sequence
  source 1..19: mol_type = other RNA
tctcacaccctccagaata

SEQ ID NO: 3123 - RNA, 19 nt, synthetic construct
  misc_feature 1..19: note = siRNA Antisense Sequence
  source 1..19: mol_type = other RNA
tattctggagggtgtgaga

SEQ ID NO: 3124 - RNA, 19 nt, synthetic construct
  misc_feature 1..19: note = siRNA Sense Sequence
  source 1..19: mol_type = other RNA
ctcacaccctccagaatat

SEQ ID NO: 3125 - RNA, 19 nt, synthetic construct
  misc_feature 1..19: note = siRNA Antisense Sequence
  source 1..19: mol_type = other RNA
atattctggagggtgtgag

SEQ ID NO: 3126 - RNA, 19 nt, synthetic construct
  misc_feature 1..19: note = siRNA Sense Sequence
  source 1..19: mol_type = other RNA
tcacaccctccagaatatg

SEQ ID NO: 3127 - RNA, 19 nt, synthetic construct
  misc_feature 1..19: note = siRNA Antisense Sequence
  source 1..19: mol_type = other RNA
catattctggagggtgtga

SEQ ID NO: 3128 - RNA, 19 nt, synthetic construct
  misc_feature 1..19: note = siRNA Sense Sequence
  source 1..19: mol_type = other RNA
cacaccctccagaatatgt

SEQ ID NO: 3129 - RNA, 19 nt, synthetic construct
  misc_feature 1..19: note = siRNA Antisense Sequence
  source 1..19: mol_type = other RNA
acatattctggagggtgtg

SEQ ID NO: 3130 - RNA, 19 nt, synthetic construct
  misc_feature 1..19: note = siRNA Sense Sequence
  source 1..19: mol_type = other RNA
acaccctccagaatatgta

SEQ ID NO: 3131 - RNA, 19 nt, synthetic construct
  misc_feature 1..19: note = siRNA Antisense Sequence
  source 1..19: mol_type = other RNA
tacatattctggagggtgt

SEQ ID NO: 3132 - RNA, 19 nt, synthetic construct
  misc_feature 1..19: note = siRNA Sense Sequence
  source 1..19: mol_type = other RNA
caccctccagaatatgtat

SEQ ID NO: 3133 - RNA, 19 nt, synthetic construct
  misc_feature 1..19: note = siRNA Antisense Sequence
  source 1..19: mol_type = other RNA
atacatattctggagggtg

SEQ ID NO: 3134 - RNA, 19 nt, synthetic construct
  misc_feature 1..19: note = siRNA Sense Sequence
  source 1..19: mol_type = other RNA
accctccagaatatgtatg

SEQ ID NO: 3135 - RNA, 19 nt, synthetic construct
  misc_feature 1..19: note = siRNA Antisense Sequence
  source 1..19: mol_type = other RNA
catacatattctggagggt

SEQ ID NO: 3136 - RNA, 19 nt, synthetic construct
  misc_feature 1..19: note = siRNA Sense Sequence
  source 1..19: mol_type = other RNA
ccctccagaatatgtatgg

SEQ ID NO: 3137 - RNA, 19 nt, synthetic construct
  misc_feature 1..19: note = siRNA Antisense Sequence
  source 1..19: mol_type = other RNA
ccatacatattctggaggg

SEQ ID NO: 3138 - RNA, 19 nt, synthetic construct
  misc_feature 1..19: note = siRNA Sense Sequence
  source 1..19: mol_type = other RNA
cctccagaatatgtatggc

SEQ ID NO: 3139 - RNA, 19 nt, synthetic construct
  misc_feature 1..19: note = siRNA Antisense Sequence
  source 1..19: mol_type = other RNA
gccatacatattctggagg

SEQ ID NO: 3140 - RNA, 19 nt, synthetic construct
  misc_feature 1..19: note = siRNA Sense Sequence
  source 1..19: mol_type = other RNA
ctccagaatatgtatggct

SEQ ID NO: 3141 - RNA, 19 nt, synthetic construct
  misc_feature 1..19: note = siRNA Antisense Sequence
  source 1..19: mol_type = other RNA
agccatacatattctggag

SEQ ID NO: 3142 - RNA, 19 nt, synthetic construct
  misc_feature 1..19: note = siRNA Sense Sequence
  source 1..19: mol_type = other RNA
tccagaatatgtatggctg

SEQ ID NO: 3143 - RNA, 19 nt, synthetic construct
  misc_feature 1..19: note = siRNA Antisense Sequence
  source 1..19: mol_type = other RNA
cagccatacatattctgga

SEQ ID NO: 3144 - RNA, 19 nt, synthetic construct
  misc_feature 1..19: note = siRNA Sense Sequence
  source 1..19: mol_type = other RNA
ccagaatatgtatggctgc

SEQ ID NO: 3145 - RNA, 19 nt, synthetic construct
  misc_feature 1..19: note = siRNA Antisense Sequence
  source 1..19: mol_type = other RNA
gcagccatacatattctgg

SEQ ID NO: 3146 - RNA, 19 nt, synthetic construct
  misc_feature 1..19: note = siRNA Sense Sequence
  source 1..19: mol_type = other RNA
cagaatatgtatggctgcg

SEQ ID NO: 3147 - RNA, 19 nt, synthetic construct
  misc_feature 1..19: note = siRNA Antisense Sequence
  source 1..19: mol_type = other RNA
cgcagccatacatattctg

SEQ ID NO: 3148 - RNA, 19 nt, synthetic construct
  misc_feature 1..19: note = siRNA Sense Sequence
  source 1..19: mol_type = other RNA
agaatatgtatggctgcga

SEQ ID NO: 3149 - RNA, 19 nt, synthetic construct
  misc_feature 1..19: note = siRNA Antisense Sequence
  source 1..19: mol_type = other RNA
tcgcagccatacatattct

SEQ ID NO: 3150 - RNA, 19 nt, synthetic construct
  misc_feature 1..19: note = siRNA Sense Sequence
  source 1..19: mol_type = other RNA
gaatatgtatggctgcgac

SEQ ID NO: 3151 - RNA, 19 nt, synthetic construct
  misc_feature 1..19: note = siRNA Antisense Sequence
  source 1..19: mol_type = other RNA
gtcgcagccatacatattc

SEQ ID NO: 3152 - RNA, 19 nt, synthetic construct
  misc_feature 1..19: note = siRNA Sense Sequence
  source 1..19: mol_type = other RNA
aatatgtatggctgcgacg

SEQ ID NO: 3153 - RNA, 19 nt, synthetic construct
  misc_feature 1..19: note = siRNA Antisense Sequence
  source 1..19: mol_type = other RNA
cgtcgcagccatacatatt

SEQ ID NO: 3154 - RNA, 19 nt, synthetic construct
  misc_feature 1..19: note = siRNA Sense Sequence
  source 1..19: mol_type = other RNA
atatgtatggctgcgacgt

SEQ ID NO: 3155 - RNA, 19 nt, synthetic construct
  misc_feature 1..19: note = siRNA Antisense Sequence
  source 1..19: mol_type = other RNA
acgtcgcagccatacatat

SEQ ID NO: 3156 - RNA, 19 nt, synthetic construct
  misc_feature 1..19: note = siRNA Sense Sequence
  source 1..19: mol_type = other RNA
tatgtatggctgcgacgtg

SEQ ID NO: 3157 - RNA, 19 nt, synthetic construct
  misc_feature 1..19: note = siRNA Antisense Sequence
  source 1..19: mol_type = other RNA
cacgtcgcagccatacata

SEQ ID NO: 3158 - RNA, 19 nt, synthetic construct
  misc_feature 1..19: note = siRNA Sense Sequence
  source 1..19: mol_type = other RNA
atgtatggctgcgacgtgg

SEQ ID NO: 3159 - RNA, 19 nt, synthetic construct
  misc_feature 1..19: note = siRNA Antisense Sequence
  source 1..19: mol_type = other RNA
ccacgtcgcagccatacat

SEQ ID NO: 3160 - RNA, 19 nt, synthetic construct
  misc_feature 1..19: note = siRNA Sense Sequence
  source 1..19: mol_type = other RNA
ggtaccaccaggacgccta

SEQ ID NO: 3161 - RNA, 19 nt, synthetic construct
  misc_feature 1..19: note = siRNA Antisense Sequence
  source 1..19: mol_type = other RNA
taggcgtcctggtggtacc

SEQ ID NO: 3162 - RNA, 19 nt, synthetic construct
  misc_feature 1..19: note = siRNA Sense Sequence
  source 1..19: mol_type = other RNA
gtaccaccaggacgcctac

SEQ ID NO: 3163 - RNA, 19 nt, synthetic construct
  misc_feature 1..19: note = siRNA Antisense Sequence
  source 1..19: mol_type = other RNA
gtaggcgtcctggtggtac

SEQ ID NO: 3164 - RNA, 19 nt, synthetic construct
  misc_feature 1..19: note = siRNA Sense Sequence
  source 1..19: mol_type = other RNA
taccaccaggacgcctacg

SEQ ID NO: 3165 - RNA, 19 nt, synthetic construct
  misc_feature 1..19: note = siRNA Antisense Sequence
  source 1..19: mol_type = other RNA
cgtaggcgtcctggtggta

SEQ ID NO: 3166 - RNA, 19 nt, synthetic construct
  misc_feature 1..19: note = siRNA Sense Sequence
  source 1..19: mol_type = other RNA
accaccaggacgcctacga

SEQ ID NO: 3167 - RNA, 19 nt, synthetic construct
  misc_feature 1..19: note = siRNA Antisense Sequence
  source 1..19: mol_type = other RNA
tcgtaggcgtcctggtggt

SEQ ID NO: 3168 - RNA, 19 nt, synthetic construct
  misc_feature 1..19: note = siRNA Sense Sequence
  source 1..19: mol_type = other RNA
aggacgcctacgacggcaa

SEQ ID NO: 3169 - RNA, 19 nt, synthetic construct
  misc_feature 1..19: note = siRNA Antisense Sequence
  source 1..19: mol_type = other RNA
ttgccgtcgtaggcgtcct

SEQ ID NO: 3170 - RNA, 19 nt, synthetic construct
  misc_feature 1..19: note = siRNA Sense Sequence
  source 1..19: mol_type = other RNA
ctcagatcacccagcgcaa

SEQ ID NO: 3171 - RNA, 19 nt, synthetic construct
  misc_feature 1..19: note = siRNA Antisense Sequence
  source 1..19: mol_type = other RNA
ttgcgctgggtgatctgag

SEQ ID NO: 3172 - RNA, 19 nt, synthetic construct
  misc_feature 1..19: note = siRNA Sense Sequence
  source 1..19: mol_type = other RNA
tcagatcacccagcgcaag

SEQ ID NO: 3173 - RNA, 19 nt, synthetic construct
  misc_feature 1..19: note = siRNA Antisense Sequence
  source 1..19: mol_type = other RNA
cttgcgctgggtgatctga

SEQ ID NO: 3174 - RNA, 19 nt, synthetic construct
  misc_feature 1..19: note = siRNA Sense Sequence
  source 1..19: mol_type = other RNA
agatcacccagcgcaagtg

SEQ ID NO: 3175 - RNA, 19 nt, synthetic construct
  misc_feature 1..19: note = siRNA Antisense Sequence
  source 1..19: mol_type = other RNA
cacttgcgctgggtgatct

SEQ ID NO: 3176 - RNA, 19 nt, synthetic construct
  misc_feature 1..19: note = siRNA Sense Sequence
  source 1..19: mol_type = other RNA
gatcacccagcgcaagtgg

SEQ ID NO: 3177 - RNA, 19 nt, synthetic construct
  misc_feature 1..19: note = siRNA Antisense Sequence
  source 1..19: mol_type = other RNA
ccacttgcgctgggtgatc

SEQ ID NO: 3178 - RNA, 19 nt, synthetic construct
  misc_feature 1..19: note = siRNA Sense Sequence
  source 1..19: mol_type = other RNA
caggacactgagcttgtgg

SEQ ID NO: 3179 - RNA, 19 nt, synthetic construct
  misc_feature 1..19: note = siRNA Antisense Sequence
  source 1..19: mol_type = other RNA
ccacaagctcagtgtcctg

SEQ ID NO: 3180 - RNA, 19 nt, synthetic construct
  misc_feature 1..19: note = siRNA Sense Sequence
  source 1..19: mol_type = other RNA
ggacactgagcttgtggag

SEQ ID NO: 3181 - RNA, 19 nt, synthetic construct
  misc_feature 1..19: note = siRNA Antisense Sequence
  source 1..19: mol_type = other RNA
ctccacaagctcagtgtcc

SEQ ID NO: 3182 - RNA, 19 nt, synthetic construct
  misc_feature 1..19: note = siRNA Sense Sequence
  source 1..19: mol_type = other RNA
gagccgtcttcccagtcca

SEQ ID NO: 3183 - RNA, 19 nt, synthetic construct
  misc_feature 1..19: note = siRNA Antisense Sequence
  source 1..19: mol_type = other RNA
tggactgggaagacggctc

SEQ ID NO: 3184 - RNA, 19 nt, synthetic construct
  misc_feature 1..19: note = siRNA Sense Sequence
  source 1..19: mol_type = other RNA
tgggcattgttgctggcct

SEQ ID NO: 3185 - RNA, 19 nt, synthetic construct
  misc_feature 1..19: note = siRNA Antisense Sequence
  source 1..19: mol_type = other RNA
aggccagcaacaatgccca

SEQ ID NO: 3186 - RNA, 19 nt, synthetic construct
  misc_feature 1..19: note = siRNA Sense Sequence
  source 1..19: mol_type = other RNA
ggcattgttgctggcctgg

SEQ ID NO: 3187 - RNA, 19 nt, synthetic construct
  misc_feature 1..19: note = siRNA Antisense Sequence
  source 1..19: mol_type = other RNA
ccaggccagcaacaatgcc

SEQ ID NO: 3188 - RNA, 19 nt, synthetic construct
  misc_feature 1..19: note = siRNA Sense Sequence
  source 1..19: mol_type = other RNA
gcattgttgctggcctggc

SEQ ID NO: 3189 - RNA, 19 nt, synthetic construct
  misc_feature 1..19: note = siRNA Antisense Sequence
  source 1..19: mol_type = other RNA
gccaggccagcaacaatgc

SEQ ID NO: 3190 - RNA, 19 nt, synthetic construct
  misc_feature 1..19: note = siRNA Sense Sequence
  source 1..19: mol_type = other RNA
cattgttgctggcctggct

SEQ ID NO: 3191 - RNA, 19 nt, synthetic construct
  misc_feature 1..19: note = siRNA Antisense Sequence
  source 1..19: mol_type = other RNA
agccaggccagcaacaatg

SEQ ID NO: 3192 - RNA, 19 nt, synthetic construct
  misc_feature 1..19: note = siRNA Sense Sequence
  source 1..19: mol_type = other RNA
attgttgctggcctggctg

SEQ ID NO: 3193 - RNA, 19 nt, synthetic construct
  misc_feature 1..19: note = siRNA Antisense Sequence
  source 1..19: mol_type = other RNA
cagccaggccagcaacaat

SEQ ID NO: 3194 - RNA, 19 nt, synthetic construct
  misc_feature 1..19: note = siRNA Sense Sequence
  source 1..19: mol_type = other RNA
tgctggcctggctgtccta

SEQ ID NO: 3195 - RNA, 19 nt, synthetic construct
  misc_feature 1..19: note = siRNA Antisense Sequence
  source 1..19: mol_type = other RNA
taggacagccaggccagca

SEQ ID NO: 3196 - RNA, 19 nt, synthetic construct
  misc_feature 1..19: note = siRNA Sense Sequence
  source 1..19: mol_type = other RNA
tggcctggctgtcctagca

SEQ ID NO: 3197 - RNA, 19 nt, synthetic construct
  misc_feature 1..19: note = siRNA Antisense Sequence
  source 1..19: mol_type = other RNA
tgctaggacagccaggcca

SEQ ID NO: 3198 - RNA, 19 nt, synthetic construct
  misc_feature 1..19: note = siRNA Sense Sequence
  source 1..19: mol_type = other RNA
gcctggctgtcctagcagt

SEQ ID NO: 3199 - RNA, 19 nt, synthetic construct
  misc_feature 1..19: note = siRNA Antisense Sequence
  source 1..19: mol_type = other RNA
actgctaggacagccaggc

SEQ ID NO: 3200 - RNA, 19 nt, synthetic construct
  misc_feature 1..19: note = siRNA Sense Sequence
  source 1..19: mol_type = other RNA
cctggctgtcctagcagtt

SEQ ID NO: 3201 - RNA, 19 nt, synthetic construct
  misc_feature 1..19: note = siRNA Antisense Sequence
  source 1..19: mol_type = other RNA
aactgctaggacagccagg

SEQ ID NO: 3202 - RNA, 19 nt, synthetic construct
  misc_feature 1..19: note = siRNA Sense Sequence
  source 1..19: mol_type = other RNA
ctggctgtcctagcagttg

SEQ ID NO: 3203 - RNA, 19 nt, synthetic construct
  misc_feature 1..19: note = siRNA Antisense Sequence
  source 1..19: mol_type = other RNA
caactgctaggacagccag

SEQ ID NO: 3204 - RNA, 19 nt, synthetic construct
  misc_feature 1..19: note = siRNA Sense Sequence
  source 1..19: mol_type = other RNA
tggctgtcctagcagttgt

SEQ ID NO: 3205 - RNA, 19 nt, synthetic construct
  misc_feature 1..19: note = siRNA Antisense Sequence
  source 1..19: mol_type = other RNA
acaactgctaggacagcca

SEQ ID NO: 3206 - RNA, 19 nt, synthetic construct
  misc_feature 1..19: note = siRNA Sense Sequence
  source 1..19: mol_type = other RNA
ggctgtcctagcagttgtg

SEQ ID NO: 3207 - RNA, 19 nt, synthetic construct
  misc_feature 1..19: note = siRNA Antisense Sequence
  source 1..19: mol_type = other RNA
cacaactgctaggacagcc

SEQ ID NO: 3208 - RNA, 19 nt, synthetic construct
  misc_feature 1..19: note = siRNA Sense Sequence
  source 1..19: mol_type = other RNA
gctgtcctagcagttgtgg

SEQ ID NO: 3209 - RNA, 19 nt, synthetic construct
  misc_feature 1..19: note = siRNA Antisense Sequence
  source 1..19: mol_type = other RNA
ccacaactgctaggacagc

SEQ ID NO: 3210 - RNA, 19 nt, synthetic construct
  misc_feature 1..19: note = siRNA Sense Sequence
  source 1..19: mol_type = other RNA
tcctagcagttgtggtcat

SEQ ID NO: 3211 - RNA, 19 nt, synthetic construct
  misc_feature 1..19: note = siRNA Antisense Sequence
  source 1..19: mol_type = other RNA
atgaccacaactgctagga

SEQ ID NO: 3212 - RNA, 19 nt, synthetic construct
  misc_feature 1..19: note = siRNA Sense Sequence
  source 1..19: mol_type = other RNA
cctagcagttgtggtcatc

SEQ ID NO: 3213 - RNA, 19 nt, synthetic construct
  misc_feature 1..19: note = siRNA Antisense Sequence
  source 1..19: mol_type = other RNA
gatgaccacaactgctagg

SEQ ID NO: 3214 - RNA, 19 nt, synthetic construct
  misc_feature 1..19: note = siRNA Sense Sequence
  source 1..19: mol_type = other RNA
ctagcagttgtggtcatcg

SEQ ID NO: 3215 - RNA, 19 nt, synthetic construct
  misc_feature 1..19: note = siRNA Antisense Sequence
  source 1..19: mol_type = other RNA
cgatgaccacaactgctag

SEQ ID NO: 3216 - RNA, 19 nt, synthetic construct
  misc_feature 1..19: note = siRNA Sense Sequence
  source 1..19: mol_type = other RNA
tagcagttgtggtcatcgg

SEQ ID NO: 3217 - RNA, 19 nt, synthetic construct
  misc_feature 1..19: note = siRNA Antisense Sequence
  source 1..19: mol_type = other RNA
ccgatgaccacaactgcta

SEQ ID NO: 3218 - RNA, 19 nt, synthetic construct
  misc_feature 1..19: note = siRNA Sense Sequence
  source 1..19: mol_type = other RNA
agcagttgtggtcatcgga

SEQ ID NO: 3219 - RNA, 19 nt, synthetic construct
  misc_feature 1..19: note = siRNA Antisense Sequence
  source 1..19: mol_type = other RNA
tccgatgaccacaactgct

SEQ ID NO: 3220 - RNA, 19 nt, synthetic construct
  misc_feature 1..19: note = siRNA Sense Sequence
  source 1..19: mol_type = other RNA
gcagttgtggtcatcggag

SEQ ID NO: 3221 - RNA, 19 nt, synthetic construct
  misc_feature 1..19: note = siRNA Antisense Sequence
  source 1..19: mol_type = other RNA
ctccgatgaccacaactgc

SEQ ID NO: 3222 - RNA, 19 nt, synthetic construct
  misc_feature 1..19: note = siRNA Sense Sequence
  source 1..19: mol_type = other RNA
cagttgtggtcatcggagc

SEQ ID NO: 3223 - RNA, 19 nt, synthetic construct
  misc_feature 1..19: note = siRNA Antisense Sequence
  source 1..19: mol_type = other RNA
gctccgatgaccacaactg

SEQ ID NO: 3224 - RNA, 19 nt, synthetic construct
  misc_feature 1..19: note = siRNA Sense Sequence
  source 1..19: mol_type = other RNA
agttgtggtcatcggagct

SEQ ID NO: 3225 - RNA, 19 nt, synthetic construct
  misc_feature 1..19: note = siRNA Antisense Sequence
  source 1..19: mol_type = other RNA
agctccgatgaccacaact

SEQ ID NO: 3226 - RNA, 19 nt, synthetic construct
  misc_feature 1..19: note = siRNA Sense Sequence
  source 1..19: mol_type = other RNA
gttgtggtcatcggagctg

SEQ ID NO: 3227 - RNA, 19 nt, synthetic construct
  misc_feature 1..19: note = siRNA Antisense Sequence
  source 1..19: mol_type = other RNA
cagctccgatgaccacaac

SEQ ID NO: 3228 - RNA, 19 nt, synthetic construct
  misc_feature 1..19: note = siRNA Sense Sequence
  source 1..19: mol_type = other RNA
ttgtggtcatcggagctgt

SEQ ID NO: 3229 - RNA, 19 nt, synthetic construct
  misc_feature 1..19: note = siRNA Antisense Sequence
  source 1..19: mol_type = other RNA
acagctccgatgaccacaa

SEQ ID NO: 3230 - RNA, 19 nt, synthetic construct
  misc_feature 1..19: note = siRNA Sense Sequence
  source 1..19: mol_type = other RNA
tgtggtcatcggagctgtg

SEQ ID NO: 3231 - RNA, 19 nt, synthetic construct
  misc_feature 1..19: note = siRNA Antisense Sequence
  source 1..19: mol_type = other RNA
cacagctccgatgaccaca

SEQ ID NO: 3232 - RNA, 19 nt, synthetic construct
  misc_feature 1..19: note = siRNA Sense Sequence
  source 1..19: mol_type = other RNA
gtggtcatcggagctgtgg

SEQ ID NO: 3233 - RNA, 19 nt, synthetic construct
  misc_feature 1..19: note = siRNA Antisense Sequence
  source 1..19: mol_type = other RNA
ccacagctccgatgaccac

SEQ ID NO: 3234 - RNA, 19 nt, synthetic construct
  misc_feature 1..19: note = siRNA Sense Sequence
  source 1..19: mol_type = other RNA
tcatcggagctgtggtcgc

SEQ ID NO: 3235 - RNA, 19 nt, synthetic construct
  misc_feature 1..19: note = siRNA Antisense Sequence
  source 1..19: mol_type = other RNA
gcgaccacagctccgatga

SEQ ID NO: 3236 - RNA, 19 nt, synthetic construct
  misc_feature 1..19: note = siRNA Sense Sequence
  source 1..19: mol_type = other RNA
catcggagctgtggtcgct

SEQ ID NO: 3237 - RNA, 19 nt, synthetic construct
  misc_feature 1..19: note = siRNA Antisense Sequence
  source 1..19: mol_type = other RNA
agcgaccacagctccgatg

SEQ ID NO: 3238 - RNA, 19 nt, synthetic construct
  misc_feature 1..19: note = siRNA Sense Sequence
  source 1..19: mol_type = other RNA
atcggagctgtggtcgctg

SEQ ID NO: 3239 - RNA, 19 nt, synthetic construct
  misc_feature 1..19: note = siRNA Antisense Sequence
  source 1..19: mol_type = other RNA
cagcgaccacagctccgat

SEQ ID NO: 3240 - RNA, 19 nt, synthetic construct
  misc_feature 1..19: note = siRNA Sense Sequence
  source 1..19: mol_type = other RNA
gtggtcgctgctgtgatgt

SEQ ID NO: 3241 - RNA, 19 nt, synthetic construct
  misc_feature 1..19: note = siRNA Antisense Sequence
  source 1..19: mol_type = other RNA
acatcacagcagcgaccac

SEQ ID NO: 3242 - RNA, 19 nt, synthetic construct
  misc_feature 1..19: note = siRNA Sense Sequence
  source 1..19: mol_type = other RNA
cgctgctgtgatgtgtagg

SEQ ID NO: 3243 - RNA, 19 nt, synthetic construct
  misc_feature 1..19: note = siRNA Antisense Sequence
  source 1..19: mol_type = other RNA
cctacacatcacagcagcg

SEQ ID NO: 3244 - RNA, 19 nt, synthetic construct
  misc_feature 1..19: note = siRNA Sense Sequence
  source 1..19: mol_type = other RNA
gctgtgatgtgtaggagga

SEQ ID NO: 3245 - RNA, 19 nt, synthetic construct
  misc_feature 1..19: note = siRNA Antisense Sequence
  source 1..19: mol_type = other RNA
tcctcctacacatcacagc

SEQ ID NO: 3246 - RNA, 19 nt, synthetic construct
  misc_feature 1..19: note = siRNA Sense Sequence
  source 1..19: mol_type = other RNA
tgatgtgtaggaggaagag

SEQ ID NO: 3247 - RNA, 19 nt, synthetic construct
  misc_feature 1..19: note = siRNA Antisense Sequence
  source 1..19: mol_type = other RNA
ctcttcctcctacacatca

SEQ ID NO: 3248 - RNA, 19 nt, synthetic construct
  misc_feature 1..19: note = siRNA Sense Sequence
  source 1..19: mol_type = other RNA
gtgtaggaggaagagctca

SEQ ID NO: 3249 - RNA, 19 nt, synthetic construct
  misc_feature 1..19: note = siRNA Antisense Sequence
  source 1..19: mol_type = other RNA
tgagctcttcctcctacac

SEQ ID NO: 3250 - RNA, 19 nt, synthetic construct
  misc_feature 1..19: note = siRNA Sense Sequence
  source 1..19: mol_type = other RNA
agctactctcaggctgcgt

SEQ ID NO: 3251 - RNA, 19 nt, synthetic construct
  misc_feature 1..19: note = siRNA Antisense Sequence
  source 1..19: mol_type = other RNA
acgcagcctgagagtagct

SEQ ID NO: 3252 - RNA, 19 nt, synthetic construct
  misc_feature 1..19: note = siRNA Sense Sequence
  source 1..19: mol_type = other RNA
gctactctcaggctgcgtg

SEQ ID NO: 3253 - RNA, 19 nt, synthetic construct
  misc_feature 1..19: note = siRNA Antisense Sequence
  source 1..19: mol_type = other RNA
cacgcagcctgagagtagc

SEQ ID NO: 3254 - RNA, 19 nt, synthetic construct
  misc_feature 1..19: note = siRNA Sense Sequence
  source 1..19: mol_type = other RNA
ctactctcaggctgcgtgc

SEQ ID NO: 3255 - RNA, 19 nt, synthetic construct
  misc_feature 1..19: note = siRNA Antisense Sequence
  source 1..19: mol_type = other RNA
gcacgcagcctgagagtag

SEQ ID NO: 3256 - RNA, 19 nt, synthetic construct
  misc_feature 1..19: note = siRNA Sense Sequence
  source 1..19: mol_type = other RNA
tactctcaggctgcgtgca

SEQ ID NO: 3257 - RNA, 19 nt, synthetic construct
  misc_feature 1..19: note = siRNA Antisense Sequence
  source 1..19: mol_type = other RNA
tgcacgcagcctgagagta

SEQ ID NO: 3258 - RNA, 19 nt, synthetic construct
  misc_feature 1..19: note = siRNA Sense Sequence
  source 1..19: mol_type = other RNA
gtgtctctcacagcttgaa

SEQ ID NO: 3259 - RNA, 19 nt, synthetic construct
  misc_feature 1..19: note = siRNA Antisense Sequence
  source 1..19: mol_type = other RNA
ttcaagctgtgagagacac

SEQ ID NO: 3260 - RNA, 19 nt, synthetic construct
  misc_feature 1..19: note = siRNA Sense Sequence
  source 1..19: mol_type = other RNA
agattctttgattgggatg

SEQ ID NO: 3261 - RNA, 19 nt, synthetic construct
  misc_feature 1..19: note = siRNA Antisense Sequence
  source 1..19: mol_type = other RNA
catcccaatcaaagaatct

SEQ ID NO: 3262 - RNA, 19 nt, synthetic construct
  misc_feature 1..19: note = siRNA Sense Sequence
  source 1..19: mol_type = other RNA
gattctttgattgggatgt

SEQ ID NO: 3263 - RNA, 19 nt, synthetic construct
  misc_feature 1..19: note = siRNA Antisense Sequence
  source 1..19: mol_type = other RNA
acatcccaatcaaagaatc

SEQ ID NO: 3264 - RNA, 19 nt, synthetic construct
  misc_feature 1..19: note = siRNA Sense Sequence
  source 1..19: mol_type = other RNA
attctttgattgggatgtt

SEQ ID NO: 3265 - RNA, 19 nt, synthetic construct
  misc_feature 1..19: note = siRNA Antisense Sequence
  source 1..19: mol_type = other RNA
aacatcccaatcaaagaat

SEQ ID NO: 3266 - RNA, 19 nt, synthetic construct
  misc_feature 1..19: note = siRNA Sense Sequence
  source 1..19: mol_type = other RNA
ttctttgattgggatgttt

SEQ ID NO: 3267 - RNA, 19 nt, synthetic construct
  misc_feature 1..19: note = siRNA Antisense Sequence
  source 1..19: mol_type = other RNA
aaacatcccaatcaaagaa

SEQ ID NO: 3268 - RNA, 19 nt, synthetic construct
  misc_feature 1..19: note = siRNA Sense Sequence
  source 1..19: mol_type = other RNA
ttgattgggatgtttcgcg

SEQ ID NO: 3269 - RNA, 19 nt, synthetic construct
  misc_feature 1..19: note = siRNA Antisense Sequence
  source 1..19: mol_type = other RNA
cgcgaaacatcccaatcaa

SEQ ID NO: 3270 - RNA, 19 nt, synthetic construct
  misc_feature 1..19: note = siRNA Sense Sequence
  source 1..19: mol_type = other RNA
tgattgggatgtttcgcgt

SEQ ID NO: 3271 - RNA, 19 nt, synthetic construct
  misc_feature 1..19: note = siRNA Antisense Sequence
  source 1..19: mol_type = other RNA
acgcgaaacatcccaatca

SEQ ID NO: 3272 - RNA, 19 nt, synthetic construct
  misc_feature 1..19: note = siRNA Sense Sequence
  source 1..19: mol_type = other RNA
gattgggatgtttcgcgtg

SEQ ID NO: 3273 - RNA, 19 nt, synthetic construct
  misc_feature 1..19: note = siRNA Antisense Sequence
  source 1..19: mol_type = other RNA
cacgcgaaacatcccaatc

SEQ ID NO: 3274 - RNA, 19 nt, synthetic construct
  misc_feature 1..19: note = siRNA Sense Sequence
  source 1..19: mol_type = other RNA
attgggatgtttcgcgtgt

SEQ ID NO: 3275 - RNA, 19 nt, synthetic construct
  misc_feature 1..19: note = siRNA Antisense Sequence
  source 1..19: mol_type = other RNA
acacgcgaaacatcccaat

SEQ ID NO: 3276 - RNA, 19 nt, synthetic construct
  misc_feature 1..19: note = siRNA Sense Sequence
  source 1..19: mol_type = other RNA
ttgggatgtttcgcgtgtg

SEQ ID NO: 3277 - RNA, 19 nt, synthetic construct
  misc_feature 1..19: note = siRNA Antisense Sequence
  source 1..19: mol_type = other RNA
cacacgcgaaacatcccaa

SEQ ID NO: 3278 - RNA, 19 nt, synthetic construct
  misc_feature 1..19: note = siRNA Sense Sequence
  source 1..19: mol_type = other RNA
gtttcgcgtgtgtggtggg

SEQ ID NO: 3279 - RNA, 19 nt, synthetic construct
  misc_feature 1..19: note = siRNA Antisense Sequence
  source 1..19: mol_type = other RNA
cccaccacacacgcgaaac

SEQ ID NO: 3280 - RNA, 19 nt, synthetic construct
  misc_feature 1..19: note = siRNA Sense Sequence
  source 1..19: mol_type = other RNA
tttcgcgtgtgtggtgggc

SEQ ID NO: 3281 - RNA, 19 nt, synthetic construct
  misc_feature 1..19: note = siRNA Antisense Sequence
  source 1..19: mol_type = other RNA
gcccaccacacacgcgaaa

SEQ ID NO: 3282 - RNA, 19 nt, synthetic construct
  misc_feature 1..19: note = siRNA Sense Sequence
  source 1..19: mol_type = other RNA
ttcgcgtgtgtggtgggct

SEQ ID NO: 3283 - RNA, 19 nt, synthetic construct
  misc_feature 1..19: note = siRNA Antisense Sequence
  source 1..19: mol_type = other RNA
agcccaccacacacgcgaa

SEQ ID NO: 3284 - RNA, 19 nt, synthetic construct
  misc_feature 1..19: note = siRNA Sense Sequence
  source 1..19: mol_type = other RNA
gcgtgtgtggtgggctgtt

SEQ ID NO: 3285 - RNA, 19 nt, synthetic construct
  misc_feature 1..19: note = siRNA Antisense Sequence
  source 1..19: mol_type = other RNA
aacagcccaccacacacgc

SEQ ID NO: 3286 - RNA, 19 nt, synthetic construct
  misc_feature 1..19: note = siRNA Sense Sequence
  source 1..19: mol_type = other RNA
cgtgtgtggtgggctgttt

SEQ ID NO: 3287 - RNA, 19 nt, synthetic construct
  misc_feature 1..19: note = siRNA Antisense Sequence
  source 1..19: mol_type = other RNA
aaacagcccaccacacacg

SEQ ID NO: 3288 - RNA, 19 nt, synthetic construct
  misc_feature 1..19: note = siRNA Sense Sequence
  source 1..19: mol_type = other RNA
gtgtgtggtgggctgttta

SEQ ID NO: 3289 - RNA, 19 nt, synthetic construct
  misc_feature 1..19: note = siRNA Antisense Sequence
  source 1..19: mol_type = other RNA
taaacagcccaccacacac

SEQ ID NO: 3290 - RNA, 19 nt, synthetic construct
  misc_feature 1..19: note = siRNA Sense Sequence
  source 1..19: mol_type = other RNA
tgtgtggtgggctgtttag

SEQ ID NO: 3291 - RNA, 19 nt, synthetic construct
  misc_feature 1..19: note = siRNA Antisense Sequence
  source 1..19: mol_type = other RNA
ctaaacagcccaccacaca

SEQ ID NO: 3292 - RNA, 19 nt, synthetic construct
  misc_feature 1..19: note = siRNA Sense Sequence
  source 1..19: mol_type = other RNA
gtgtggtgggctgtttaga

SEQ ID NO: 3293 - RNA, 19 nt, synthetic construct
  misc_feature 1..19: note = siRNA Antisense Sequence
  source 1..19: mol_type = other RNA
tctaaacagcccaccacac

SEQ ID NO: 3294 - RNA, 19 nt, synthetic construct
  misc_feature 1..19: note = siRNA Sense Sequence
  source 1..19: mol_type = other RNA
tgtggtgggctgtttagac

SEQ ID NO: 3295 - RNA, 19 nt, synthetic construct
  misc_feature 1..19: note = siRNA Antisense Sequence
  source 1..19: mol_type = other RNA
gtctaaacagcccaccaca

SEQ ID NO: 3296 - RNA, 19 nt, synthetic construct
  misc_feature 1..19: note = siRNA Sense Sequence
  source 1..19: mol_type = other RNA
gtggtgggctgtttagact

SEQ ID NO: 3297 - RNA, 19 nt, synthetic construct
  misc_feature 1..19: note = siRNA Antisense Sequence
  source 1..19: mol_type = other RNA
agtctaaacagcccaccac

SEQ ID NO: 3298 - RNA, 19 nt, synthetic construct
  misc_feature 1..19: note = siRNA Sense Sequence
  source 1..19: mol_type = other RNA
tgggctgtttagactgtca

SEQ ID NO: 3299 - RNA, 19 nt, synthetic construct
  misc_feature 1..19: note = siRNA Antisense Sequence
  source 1..19: mol_type = other RNA
tgacagtctaaacagccca

SEQ ID NO: 3300 - RNA, 19 nt, synthetic construct
  misc_feature 1..19: note = siRNA Sense Sequence
  source 1..19: mol_type = other RNA
ctgtttagactgtcatcac

SEQ ID NO: 3301 - RNA, 19 nt, synthetic construct
  misc_feature 1..19: note = siRNA Antisense Sequence
  source 1..19: mol_type = other RNA
gtgatgacagtctaaacag

SEQ ID NO: 3302 - RNA, 19 nt, synthetic construct
  misc_feature 1..19: note = siRNA Sense Sequence
  source 1..19: mol_type = other RNA
tgtttagactgtcatcact

SEQ ID NO: 3303 - RNA, 19 nt, synthetic construct
  misc_feature 1..19: note = siRNA Antisense Sequence
  source 1..19: mol_type = other RNA
agtgatgacagtctaaaca

SEQ ID NO: 3304 - RNA, 19 nt, synthetic construct
  misc_feature 1..19: note = siRNA Sense Sequence
  source 1..19: mol_type = other RNA
gtttagactgtcatcactt

SEQ ID NO: 3305 - RNA, 19 nt, synthetic construct
  misc_feature 1..19: note = siRNA Antisense Sequence
  source 1..19: mol_type = other RNA
aagtgatgacagtctaaac

SEQ ID NO: 3306 - RNA, 19 nt, synthetic construct
  misc_feature 1..19: note = siRNA Sense Sequence
  source 1..19: mol_type = other RNA
tttagactgtcatcactta

SEQ ID NO: 3307 - RNA, 19 nt, synthetic construct
  misc_feature 1..19: note = siRNA Antisense Sequence
  source 1..19: mol_type = other RNA
taagtgatgacagtctaaa

SEQ ID NO: 3308 - RNA, 19 nt, synthetic construct
  misc_feature 1..19: note = siRNA Sense Sequence
  source 1..19: mol_type = other RNA
ttagactgtcatcacttac

SEQ ID NO: 3309 - RNA, 19 nt, synthetic construct
  misc_feature 1..19: note = siRNA Antisense Sequence
  source 1..19: mol_type = other RNA
gtaagtgatgacagtctaa

SEQ ID NO: 3310 - RNA, 19 nt, synthetic construct
  misc_feature 1..19: note = siRNA Sense Sequence
  source 1..19: mol_type = other RNA
tagactgtcatcacttacc

SEQ ID NO: 3311 - RNA, 19 nt, synthetic construct
  misc_feature 1..19: note = siRNA Antisense Sequence
  source 1..19: mol_type = other RNA
ggtaagtgatgacagtcta

SEQ ID NO: 3312 - RNA, 19 nt, synthetic construct
  misc_feature 1..19: note = siRNA Sense Sequence
  source 1..19: mol_type = other RNA
agactgtcatcacttacca

SEQ ID NO: 3313 - RNA, 19 nt, synthetic construct
  misc_feature 1..19: note = siRNA Antisense Sequence
  source 1..19: mol_type = other RNA
tggtaagtgatgacagtct

SEQ ID NO: 3314 - RNA, 19 nt, synthetic construct
  misc_feature 1..19: note = siRNA Sense Sequence
  source 1..19: mol_type = other RNA
gactgtcatcacttaccat

SEQ ID NO: 3315 - RNA, 19 nt, synthetic construct
  misc_feature 1..19: note = siRNA Antisense Sequence
  source 1..19: mol_type = other RNA
atggtaagtgatgacagtc

SEQ ID NO: 3316 - RNA, 19 nt, synthetic construct
  misc_feature 1..19: note = siRNA Sense Sequence
  source 1..19: mol_type = other RNA
actgtcatcacttaccatg

SEQ ID NO: 3317 - RNA, 19 nt, synthetic construct
  misc_feature 1..19: note = siRNA Antisense Sequence
  source 1..19: mol_type = other RNA
catggtaagtgatgacagt

SEQ ID NO: 3318 - RNA, 19 nt, synthetic construct
  misc_feature 1..19: note = siRNA Sense Sequence
  source 1..19: mol_type = other RNA
catcacttaccatgactaa

SEQ ID NO: 3319 - RNA, 19 nt, synthetic construct
  misc_feature 1..19: note = siRNA Antisense Sequence
  source 1..19: mol_type = other RNA
ttagtcatggtaagtgatg

SEQ ID NO: 3320 - RNA, 19 nt, synthetic construct
  misc_feature 1..19: note = siRNA Sense Sequence
  source 1..19: mol_type = other RNA
atcacttaccatgactaac

SEQ ID NO: 3321 - RNA, 19 nt, synthetic construct
  misc_feature 1..19: note = siRNA Antisense Sequence
  source 1..19: mol_type = other RNA
gttagtcatggtaagtgat

SEQ ID NO: 3322 - RNA, 19 nt, synthetic construct
  misc_feature 1..19: note = siRNA Sense Sequence
  source 1..19: mol_type = other RNA
tcacttaccatgactaacc

SEQ ID NO: 3323 - RNA, 19 nt, synthetic construct
  misc_feature 1..19: note = siRNA Antisense Sequence
  source 1..19: mol_type = other RNA
ggttagtcatggtaagtga

SEQ ID NO: 3324 - RNA, 19 nt, synthetic construct
  misc_feature 1..19: note = siRNA Sense Sequence
  source 1..19: mol_type = other RNA
cacttaccatgactaacca

SEQ ID NO: 3325 - RNA, 19 nt, synthetic construct
  misc_feature 1..19: note = siRNA Antisense Sequence
  source 1..19: mol_type = other RNA
tggttagtcatggtaagtg

SEQ ID NO: 3326 - RNA, 19 nt, synthetic construct
  misc_feature 1..19: note = siRNA Sense Sequence
  source 1..19: mol_type = other RNA
acttaccatgactaaccag

SEQ ID NO: 3327 - RNA, 19 nt, synthetic construct
  misc_feature 1..19: note = siRNA Antisense Sequence
  source 1..19: mol_type = other RNA
ctggttagtcatggtaagt

SEQ ID NO: 3328 - RNA, 19 nt, synthetic construct
  misc_feature 1..19: note = siRNA Sense Sequence
  source 1..19: mol_type = other RNA
cttaccatgactaaccaga

SEQ ID NO: 3329 - RNA, 19 nt, synthetic construct
  misc_feature 1..19: note = siRNA Antisense Sequence
  source 1..19: mol_type = other RNA
tctggttagtcatggtaag

SEQ ID NO: 3330 - RNA, 19 nt, synthetic construct
  misc_feature 1..19: note = siRNA Sense Sequence
  source 1..19: mol_type = other RNA
ttaccatgactaaccagaa

SEQ ID NO: 3331 - RNA, 19 nt, synthetic construct
  misc_feature 1..19: note = siRNA Antisense Sequence
  source 1..19: mol_type = other RNA
ttctggttagtcatggtaa

SEQ ID NO: 3332 - RNA, 19 nt, synthetic construct
  misc_feature 1..19: note = siRNA Sense Sequence
  source 1..19: mol_type = other RNA
taccatgactaaccagaat

SEQ ID NO: 3333 - RNA, 19 nt, synthetic construct
  misc_feature 1..19: note = siRNA Antisense Sequence
  source 1..19: mol_type = other RNA
attctggttagtcatggta

SEQ ID NO: 3334 - RNA, 19 nt, synthetic construct
  misc_feature 1..19: note = siRNA Sense Sequence
  source 1..19: mol_type = other RNA
accatgactaaccagaatt

SEQ ID NO: 3335 - RNA, 19 nt, synthetic construct
  misc_feature 1..19: note = siRNA Antisense Sequence
  source 1..19: mol_type = other RNA
aattctggttagtcatggt

SEQ ID NO: 3336 - RNA, 19 nt, synthetic construct
  misc_feature 1..19: note = siRNA Sense Sequence
  source 1..19: mol_type = other RNA
ctaaccagaatttgttcat

SEQ ID NO: 3337 - RNA, 19 nt, synthetic construct
  misc_feature 1..19: note = siRNA Antisense Sequence
  source 1..19: mol_type = other RNA
atgaacaaattctggttag

SEQ ID NO: 3338 - RNA, 19 nt, synthetic construct
  misc_feature 1..19: note = siRNA Sense Sequence
  source 1..19: mol_type = other RNA
taaccagaatttgttcatg

SEQ ID NO: 3339 - RNA, 19 nt, synthetic construct
  misc_feature 1..19: note = siRNA Antisense Sequence
  source 1..19: mol_type = other RNA
catgaacaaattctggtta

SEQ ID NO: 3340 - RNA, 19 nt, synthetic construct
  misc_feature 1..19: note = siRNA Sense Sequence
  source 1..19: mol_type = other RNA
cagaatttgttcatgactg

SEQ ID NO: 3341 - RNA, 19 nt, synthetic construct
  misc_feature 1..19: note = siRNA Antisense Sequence
  source 1..19: mol_type = other RNA
cagtcatgaacaaattctg

SEQ ID NO: 3342 - RNA, 19 nt, synthetic construct
  misc_feature 1..19: note = siRNA Sense Sequence
  source 1..19: mol_type = other RNA
agaatttgttcatgactgt

SEQ ID NO: 3343 - RNA, 19 nt, synthetic construct
  misc_feature 1..19: note = siRNA Antisense Sequence
  source 1..19: mol_type = other RNA
acagtcatgaacaaattct

SEQ ID NO: 3344 - RNA, 19 nt, synthetic construct
  misc_feature 1..19: note = siRNA Sense Sequence
  source 1..19: mol_type = other RNA
tttgttcatgactgttgtt

SEQ ID NO: 3345 - RNA, 19 nt, synthetic construct
  misc_feature 1..19: note = siRNA Antisense Sequence
  source 1..19: mol_type = other RNA
aacaacagtcatgaacaaa

SEQ ID NO: 3346 - RNA, 19 nt, synthetic construct
  misc_feature 1..19: note = siRNA Sense Sequence
  source 1..19: mol_type = other RNA
ttgttcatgactgttgttt

SEQ ID NO: 3347 - RNA, 19 nt, synthetic construct
  misc_feature 1..19: note = siRNA Antisense Sequence
  source 1..19: mol_type = other RNA
aaacaacagtcatgaacaa

SEQ ID NO: 3348 - RNA, 19 nt, synthetic construct
  misc_feature 1..19: note = siRNA Sense Sequence
  source 1..19: mol_type = other RNA
tgttcatgactgttgtttt

SEQ ID NO: 3349 - RNA, 19 nt, synthetic construct
  misc_feature 1..19: note = siRNA Antisense Sequence
  source 1..19: mol_type = other RNA
aaaacaacagtcatgaaca

SEQ ID NO: 3350 - RNA, 19 nt, synthetic construct
  misc_feature 1..19: note = siRNA Sense Sequence
  source 1..19: mol_type = other RNA
gttcatgactgttgttttc

SEQ ID NO: 3351 - RNA, 19 nt, synthetic construct
  misc_feature 1..19: note = siRNA Antisense Sequence
  source 1..19: mol_type = other RNA
gaaaacaacagtcatgaac

SEQ ID NO: 3352 - RNA, 19 nt, synthetic construct
  misc_feature 1..19: note = siRNA Sense Sequence
  source 1..19: mol_type = other RNA
tcatgactgttgttttctg

SEQ ID NO: 3353 - RNA, 19 nt, synthetic construct
  misc_feature 1..19: note = siRNA Antisense Sequence
  source 1..19: mol_type = other RNA
cagaaaacaacagtcatga

SEQ ID NO: 3354 - RNA, 19 nt, synthetic construct
  misc_feature 1..19: note = siRNA Sense Sequence
  source 1..19: mol_type = other RNA
catgactgttgttttctgt

SEQ ID NO: 3355 - RNA, 19 nt, synthetic construct
  misc_feature 1..19: note = siRNA Antisense Sequence
  source 1..19: mol_type = other RNA
acagaaaacaacagtcatg

SEQ ID NO: 3356 - RNA, 19 nt, synthetic construct
  misc_feature 1..19: note = siRNA Sense Sequence
  source 1..19: mol_type = other RNA
atgactgttgttttctgta

SEQ ID NO: 3357 - RNA, 19 nt, synthetic construct
  misc_feature 1..19: note = siRNA Antisense Sequence
  source 1..19: mol_type = other RNA
tacagaaaacaacagtcat

SEQ ID NO: 3358 - RNA, 19 nt, synthetic construct
  misc_feature 1..19: note = siRNA Sense Sequence
  source 1..19: mol_type = other RNA
acagctgtcttgtgaggga

SEQ ID NO: 3359 - RNA, 19 nt, synthetic construct
  misc_feature 1..19: note = siRNA Antisense Sequence
  source 1..19: mol_type = other RNA
tccctcacaagacagctgt

SEQ ID NO: 3360 - RNA, 19 nt, synthetic construct
  misc_feature 1..19: note = siRNA Sense Sequence
  source 1..19: mol_type = other RNA
agctgtcttgtgagggact

SEQ ID NO: 3361 - RNA, 19 nt, synthetic construct
  misc_feature 1..19: note = siRNA Antisense Sequence
  source 1..19: mol_type = other RNA
agtccctcacaagacagct

SEQ ID NO: 3362 - RNA, 19 nt, synthetic construct
  misc_feature 1..19: note = siRNA Sense Sequence
  source 1..19: mol_type = other RNA
atgcaggatttcttcacgc

SEQ ID NO: 3363 - RNA, 19 nt, synthetic construct
  misc_feature 1..19: note = siRNA Antisense Sequence
  source 1..19: mol_type = other RNA
gcgtgaagaaatcctgcat

SEQ ID NO: 3364 - RNA, 19 nt, synthetic construct
  misc_feature 1..19: note = siRNA Sense Sequence
  source 1..19: mol_type = other RNA
tgcaggatttcttcacgcc

SEQ ID NO: 3365 - RNA, 19 nt, synthetic construct
  misc_feature 1..19: note = siRNA Antisense Sequence
  source 1..19: mol_type = other RNA
ggcgtgaagaaatcctgca

SEQ ID NO: 3366 - RNA, 19 nt, synthetic construct
  misc_feature 1..19: note = siRNA Sense Sequence
  source 1..19: mol_type = other RNA
gcaggatttcttcacgcct

SEQ ID NO: 3367 - RNA, 19 nt, synthetic construct
  misc_feature 1..19: note = siRNA Antisense Sequence
  source 1..19: mol_type = other RNA
aggcgtgaagaaatcctgc

SEQ ID NO: 3368 - RNA, 19 nt, synthetic construct
  misc_feature 1..19: note = siRNA Sense Sequence
  source 1..19: mol_type = other RNA
caggatttcttcacgcctc

SEQ ID NO: 3369 - RNA, 19 nt, synthetic construct
  misc_feature 1..19: note = siRNA Antisense Sequence
  source 1..19: mol_type = other RNA
gaggcgtgaagaaatcctg

SEQ ID NO: 3370 - RNA, 19 nt, synthetic construct
  misc_feature 1..19: note = siRNA Sense Sequence
  source 1..19: mol_type = other RNA
aggatttcttcacgcctcc

SEQ ID NO: 3371 - RNA, 19 nt, synthetic construct
  misc_feature 1..19: note = siRNA Antisense Sequence
  source 1..19: mol_type = other RNA
ggaggcgtgaagaaatcct

SEQ ID NO: 3372 - RNA, 19 nt, synthetic construct
  misc_feature 1..19: note = siRNA Sense Sequence
  source 1..19: mol_type = other RNA
ggatttcttcacgcctccc

SEQ ID NO: 3373 - RNA, 19 nt, synthetic construct
  misc_feature 1..19: note = siRNA Antisense Sequence
  source 1..19: mol_type = other RNA
gggaggcgtgaagaaatcc

SEQ ID NO: 3374 - RNA, 19 nt, synthetic construct
  misc_feature 1..19: note = siRNA Sense Sequence
  source 1..19: mol_type = other RNA
tgacttcaagagcctctgg

SEQ ID NO: 3375 - RNA, 19 nt, synthetic construct
  misc_feature 1..19: note = siRNA Antisense Sequence
  source 1..19: mol_type = other RNA
ccagaggctcttgaagtca

SEQ ID NO: 3376 - RNA, 19 nt, synthetic construct
  misc_feature 1..19: note = siRNA Sense Sequence
  source 1..19: mol_type = other RNA
acttcaagagcctctggca

SEQ ID NO: 3377 - RNA, 19 nt, synthetic construct
  misc_feature 1..19: note = siRNA Antisense Sequence
  source 1..19: mol_type = other RNA
tgccagaggctcttgaagt

SEQ ID NO: 3378 - RNA, 19 nt, synthetic construct
  misc_feature 1..19: note = siRNA Sense Sequence
  source 1..19: mol_type = other RNA
tcaagagcctctggcatct

SEQ ID NO: 3379 - RNA, 19 nt, synthetic construct
  misc_feature 1..19: note = siRNA Antisense Sequence
  source 1..19: mol_type = other RNA
agatgccagaggctcttga

SEQ ID NO: 3380 - RNA, 19 nt, synthetic construct
  misc_feature 1..19: note = siRNA Sense Sequence
  source 1..19: mol_type = other RNA
ctggcatctctttctgcaa

SEQ ID NO: 3381 - RNA, 19 nt, synthetic construct
  misc_feature 1..19: note = siRNA Antisense Sequence
  source 1..19: mol_type = other RNA
ttgcagaaagagatgccag

SEQ ID NO: 3382 - RNA, 19 nt, synthetic construct
  misc_feature 1..19: note = siRNA Sense Sequence
  source 1..19: mol_type = other RNA
cacctgaatgtgtctgcgt

SEQ ID NO: 3383 - RNA, 19 nt, synthetic construct
  misc_feature 1..19: note = siRNA Antisense Sequence
  source 1..19: mol_type = other RNA
acgcagacacattcaggtg

SEQ ID NO: 3384 - RNA, 19 nt, synthetic construct
  misc_feature 1..19: note = siRNA Sense Sequence
  source 1..19: mol_type = other RNA
acctgaatgtgtctgcgtc

SEQ ID NO: 3385 - RNA, 19 nt, synthetic construct
  misc_feature 1..19: note = siRNA Antisense Sequence
  source 1..19: mol_type = other RNA
gacgcagacacattcaggt

SEQ ID NO: 3386 - RNA, 19 nt, synthetic construct
  misc_feature 1..19: note = siRNA Sense Sequence
  source 1..19: mol_type = other RNA
cctgaatgtgtctgcgtcc

SEQ ID NO: 3387 - RNA, 19 nt, synthetic construct
  misc_feature 1..19: note = siRNA Antisense Sequence
  source 1..19: mol_type = other RNA
ggacgcagacacattcagg

SEQ ID NO: 3388 - RNA, 19 nt, synthetic construct
  misc_feature 1..19: note = siRNA Sense Sequence
  source 1..19: mol_type = other RNA
aatgtgtctgcgtccctgt

SEQ ID NO: 3389 - RNA, 19 nt, synthetic construct
  misc_feature 1..19: note = siRNA Antisense Sequence
  source 1..19: mol_type = other RNA
acagggacgcagacacatt

SEQ ID NO: 3390 - RNA, 19 nt, synthetic construct
  misc_feature 1..19: note = siRNA Sense Sequence
  source 1..19: mol_type = other RNA
atgtgtctgcgtccctgtt

SEQ ID NO: 3391 - RNA, 19 nt, synthetic construct
  misc_feature 1..19: note = siRNA Antisense Sequence
  source 1..19: mol_type = other RNA
aacagggacgcagacacat

SEQ ID NO: 3392 - RNA, 19 nt, synthetic construct
  misc_feature 1..19: note = siRNA Sense Sequence
  source 1..19: mol_type = other RNA
gtgtctgcgtccctgttag

SEQ ID NO: 3393 - RNA, 19 nt, synthetic construct
  misc_feature 1..19: note = siRNA Antisense Sequence
  source 1..19: mol_type = other RNA
ctaacagggacgcagacac

SEQ ID NO: 3394 - RNA, 19 nt, synthetic construct
  misc_feature 1..19: note = siRNA Sense Sequence
  source 1..19: mol_type = other RNA
tgtctgcgtccctgttagc

SEQ ID NO: 3395 - RNA, 19 nt, synthetic construct
  misc_feature 1..19: note = siRNA Antisense Sequence
  source 1..19: mol_type = other RNA
gctaacagggacgcagaca

SEQ ID NO: 3396 - RNA, 19 nt, synthetic construct
  misc_feature 1..19: note = siRNA Sense Sequence
  source 1..19: mol_type = other RNA
gtctgcgtccctgttagca

SEQ ID NO: 3397 - RNA, 19 nt, synthetic construct
  misc_feature 1..19: note = siRNA Antisense Sequence
  source 1..19: mol_type = other RNA
tgctaacagggacgcagac

SEQ ID NO: 3398 - RNA, 19 nt, synthetic construct
  misc_feature 1..19: note = siRNA Sense Sequence
  source 1..19: mol_type = other RNA
tctgcgtccctgttagcat

SEQ ID NO: 3399 - RNA, 19 nt, synthetic construct
  misc_feature 1..19: note = siRNA Antisense Sequence
  source 1..19: mol_type = other RNA
atgctaacagggacgcaga

SEQ ID NO: 3400 - RNA, 19 nt, synthetic construct
  misc_feature 1..19: note = siRNA Sense Sequence
  source 1..19: mol_type = other RNA
ctgcgtccctgttagcata

SEQ ID NO: 3401 - RNA, 19 nt, synthetic construct
  misc_feature 1..19: note = siRNA Antisense Sequence
  source 1..19: mol_type = other RNA
tatgctaacagggacgcag

SEQ ID NO: 3402 - RNA, 19 nt, synthetic construct
  misc_feature 1..19: note = siRNA Sense Sequence
  source 1..19: mol_type = other RNA
tgcgtccctgttagcataa

SEQ ID NO: 3403 - RNA, 19 nt, synthetic construct
  misc_feature 1..19: note = siRNA Antisense Sequence
  source 1..19: mol_type = other RNA
ttatgctaacagggacgca

SEQ ID NO: 3404 - RNA, 19 nt, synthetic construct
  misc_feature 1..19: note = siRNA Sense Sequence
  source 1..19: mol_type = other RNA
gcgtccctgttagcataat

SEQ ID NO: 3405 - RNA, 19 nt, synthetic construct
  misc_feature 1..19: note = siRNA Antisense Sequence
  source 1..19: mol_type = other RNA
attatgctaacagggacgc

SEQ ID NO: 3406 - RNA, 19 nt, synthetic construct
  misc_feature 1..19: note = siRNA Sense Sequence
  source 1..19: mol_type = other RNA
cgtccctgttagcataatg

SEQ ID NO: 3407 - RNA, 19 nt, synthetic construct
  misc_feature 1..19: note = siRNA Antisense Sequence
  source 1..19: mol_type = other RNA
cattatgctaacagggacg

SEQ ID NO: 3408 - RNA, 19 nt, synthetic construct
  misc_feature 1..19: note = siRNA Sense Sequence
  source 1..19: mol_type = other RNA
tagcataatgtgaggaggt

SEQ ID NO: 3409 - RNA, 19 nt, synthetic construct
  misc_feature 1..19: note = siRNA Antisense Sequence
  source 1..19: mol_type = other RNA
acctcctcacattatgcta

SEQ ID NO: 3410 - RNA, 19 nt, synthetic construct
  misc_feature 1..19: note = siRNA Sense Sequence
  source 1..19: mol_type = other RNA
gttcccatgctgacctgtg

SEQ ID NO: 3411 - RNA, 19 nt, synthetic construct
  misc_feature 1..19: note = siRNA Antisense Sequence
  source 1..19: mol_type = other RNA
cacaggtcagcatgggaac

SEQ ID NO: 3412 - RNA, 19 nt, synthetic construct
  misc_feature 1..19: note = siRNA Sense Sequence
  source 1..19: mol_type = other RNA
ttcccatgctgacctgtgt

SEQ ID NO: 3413 - RNA, 19 nt, synthetic construct
  misc_feature 1..19: note = siRNA Antisense Sequence
  source 1..19: mol_type = other RNA
acacaggtcagcatgggaa

SEQ ID NO: 3414 - RNA, 19 nt, synthetic construct
  misc_feature 1..19: note = siRNA Sense Sequence
  source 1..19: mol_type = other RNA
tcccatgctgacctgtgtt

SEQ ID NO: 3415 - RNA, 19 nt, synthetic construct
  misc_feature 1..19: note = siRNA Antisense Sequence
  source 1..19: mol_type = other RNA
aacacaggtcagcatggga

SEQ ID NO: 3416 - RNA, 19 nt, synthetic construct
  misc_feature 1..19: note = siRNA Sense Sequence
  source 1..19: mol_type = other RNA
cccatgctgacctgtgttt

SEQ ID NO: 3417 - RNA, 19 nt, synthetic construct
  misc_feature 1..19: note = siRNA Antisense Sequence
  source 1..19: mol_type = other RNA
aaacacaggtcagcatggg

SEQ ID NO: 3418 - RNA, 19 nt, synthetic construct
  misc_feature 1..19: note = siRNA Sense Sequence
  source 1..19: mol_type = other RNA
ccagtcatctttcctgttc

SEQ ID NO: 3419 - RNA, 19 nt, synthetic construct
  misc_feature 1..19: note = siRNA Antisense Sequence
  source 1..19: mol_type = other RNA
gaacaggaaagatgactgg

SEQ ID NO: 3420 - RNA, 19 nt, synthetic construct
  misc_feature 1..19: note = siRNA Sense Sequence
  source 1..19: mol_type = other RNA
cagtcatctttcctgttcc

SEQ ID NO: 3421 - RNA, 19 nt, synthetic construct
  misc_feature 1..19: note = siRNA Antisense Sequence
  source 1..19: mol_type = other RNA
ggaacaggaaagatgactg

SEQ ID NO: 3422 - RNA, 19 nt, synthetic construct
  misc_feature 1..19: note = siRNA Sense Sequence
  source 1..19: mol_type = other RNA
agtcatctttcctgttcca

SEQ ID NO: 3423 - RNA, 19 nt, synthetic construct
  misc_feature 1..19: note = siRNA Antisense Sequence
  source 1..19: mol_type = other RNA
tggaacaggaaagatgact

SEQ ID NO: 3424 - RNA, 19 nt, synthetic construct
  misc_feature 1..19: note = siRNA Sense Sequence
  source 1..19: mol_type = other RNA
tctgtctcaactttatgtg

SEQ ID NO: 3425 - RNA, 19 nt, synthetic construct
  misc_feature 1..19: note = siRNA Antisense Sequence
  source 1..19: mol_type = other RNA
cacataaagttgagacaga

SEQ ID NO: 3426 - RNA, 19 nt, synthetic construct
  misc_feature 1..19: note = siRNA Sense Sequence
  source 1..19: mol_type = other RNA
ctgtctcaactttatgtgc

SEQ ID NO: 3427 - RNA, 19 nt, synthetic construct
  misc_feature 1..19: note = siRNA Antisense Sequence
  source 1..19: mol_type = other RNA
gcacataaagttgagacag

SEQ ID NO: 3428 - RNA, 19 nt, synthetic construct
  misc_feature 1..19: note = siRNA Sense Sequence
  source 1..19: mol_type = other RNA
tgtctcaactttatgtgca

SEQ ID NO: 3429 - RNA, 19 nt, synthetic construct
  misc_feature 1..19: note = siRNA Antisense Sequence
  source 1..19: mol_type = other RNA
tgcacataaagttgagaca

SEQ ID NO: 3430 - RNA, 19 nt, synthetic construct
  misc_feature 1..19: note = siRNA Sense Sequence
  source 1..19: mol_type = other RNA
aactttatgtgcactgagc

SEQ ID NO: 3431 - RNA, 19 nt, synthetic construct
  misc_feature 1..19: note = siRNA Antisense Sequence
  source 1..19: mol_type = other RNA
gctcagtgcacataaagtt

SEQ ID NO: 3432 - RNA, 19 nt, synthetic construct
  misc_feature 1..19: note = siRNA Sense Sequence
  source 1..19: mol_type = other RNA
actttatgtgcactgagct

SEQ ID NO: 3433 - RNA, 19 nt, synthetic construct
  misc_feature 1..19: note = siRNA Antisense Sequence
  source 1..19: mol_type = other RNA
agctcagtgcacataaagt

SEQ ID NO: 3434 - RNA, 19 nt, synthetic construct
  misc_feature 1..19: note = siRNA Sense Sequence
  source 1..19: mol_type = other RNA
actgagctgcaacttctta

SEQ ID NO: 3435 - RNA, 19 nt, synthetic construct
  misc_feature 1..19: note = siRNA Antisense Sequence
  source 1..19: mol_type = other RNA
taagaagttgcagctcagt

SEQ ID NO: 3436 - RNA, 19 nt, synthetic construct
  misc_feature 1..19: note = siRNA Sense Sequence
  source 1..19: mol_type = other RNA
tgagctgcaacttcttact

SEQ ID NO: 3437 - RNA, 19 nt, synthetic construct
  misc_feature 1..19: note = siRNA Antisense Sequence
  source 1..19: mol_type = other RNA
agtaagaagttgcagctca

SEQ ID NO: 3438 - RNA, 19 nt, synthetic construct
  misc_feature 1..19: note = siRNA Sense Sequence
  source 1..19: mol_type = other RNA
gctgcaacttcttacttcc

SEQ ID NO: 3439 - RNA, 19 nt, synthetic construct
  misc_feature 1..19: note = siRNA Antisense Sequence
  source 1..19: mol_type = other RNA
ggaagtaagaagttgcagc

SEQ ID NO: 3440 - RNA, 19 nt, synthetic construct
  misc_feature 1..19: note = siRNA Sense Sequence
  source 1..19: mol_type = other RNA
tgcaacttcttacttccct

SEQ ID NO: 3441 - RNA, 19 nt, synthetic construct
  misc_feature 1..19: note = siRNA Antisense Sequence
  source 1..19: mol_type = other RNA
agggaagtaagaagttgca

SEQ ID NO: 3442 - RNA, 19 nt, synthetic construct
  misc_feature 1..19: note = siRNA Sense Sequence
  source 1..19: mol_type = other RNA
aacttcttacttccctact

SEQ ID NO: 3443 - RNA, 19 nt, synthetic construct
  misc_feature 1..19: note = siRNA Antisense Sequence
  source 1..19: mol_type = other RNA
agtagggaagtaagaagtt

SEQ ID NO: 3444 - RNA, 19 nt, synthetic construct
  misc_feature 1..19: note = siRNA Sense Sequence
  source 1..19: mol_type = other RNA
accttccagaatctgcatg

SEQ ID NO: 3445 - RNA, 19 nt, synthetic construct
  misc_feature 1..19: note = siRNA Antisense Sequence
  source 1..19: mol_type = other RNA
catgcagattctggaaggt

SEQ ID NO: 3446 - RNA, 19 nt, synthetic construct
  misc_feature 1..19: note = siRNA Sense Sequence
  source 1..19: mol_type = other RNA
cttccagaatctgcatgtt

SEQ ID NO: 3447 - RNA, 19 nt, synthetic construct
  misc_feature 1..19: note = siRNA Antisense Sequence
  source 1..19: mol_type = other RNA
aacatgcagattctggaag

SEQ ID NO: 3448 - RNA, 19 nt, synthetic construct
  misc_feature 1..19: note = siRNA Sense Sequence
  source 1..19: mol_type = other RNA
ttccagaatctgcatgttc

SEQ ID NO: 3449 - RNA, 19 nt, synthetic construct
  misc_feature 1..19: note = siRNA Antisense Sequence
  source 1..19: mol_type = other RNA
gaacatgcagattctggaa

SEQ ID NO: 3450 - RNA, 19 nt, synthetic construct
  misc_feature 1..19: note = siRNA Sense Sequence
  source 1..19: mol_type = other RNA
tccagaatctgcatgttcg

SEQ ID NO: 3451 - RNA, 19 nt, synthetic construct
  misc_feature 1..19: note = siRNA Antisense Sequence
  source 1..19: mol_type = other RNA
cgaacatgcagattctgga

SEQ ID NO: 3452 - RNA, 19 nt, synthetic construct
  misc_feature 1..19: note = siRNA Sense Sequence
  source 1..19: mol_type = other RNA
ccagaatctgcatgttcgc

SEQ ID NO: 3453 - RNA, 19 nt, synthetic construct
  misc_feature 1..19: note = siRNA Antisense Sequence
  source 1..19: mol_type = other RNA
gcgaacatgcagattctgg

SEQ ID NO: 3454 - RNA, 19 nt, synthetic construct
  misc_feature 1..19: note = siRNA Sense Sequence
  source 1..19: mol_type = other RNA
cagaatctgcatgttcgct

SEQ ID NO: 3455 - RNA, 19 nt, synthetic construct
  misc_feature 1..19: note = siRNA Antisense Sequence
  source 1..19: mol_type = other RNA
agcgaacatgcagattctg

SEQ ID NO: 3456 - RNA, 19 nt, synthetic construct
  misc_feature 1..19: note = siRNA Sense Sequence
  source 1..19: mol_type = other RNA
agaatctgcatgttcgctg

SEQ ID NO: 3457 - RNA, 19 nt, synthetic construct
  misc_feature 1..19: note = siRNA Antisense Sequence
  source 1..19: mol_type = other RNA
cagcgaacatgcagattct

SEQ ID NO: 3458 - RNA, 19 nt, synthetic construct
  misc_feature 1..19: note = siRNA Sense Sequence
  source 1..19: mol_type = other RNA
gaatctgcatgttcgctgt

SEQ ID NO: 3459 - RNA, 19 nt, synthetic construct
  misc_feature 1..19: note = siRNA Antisense Sequence
  source 1..19: mol_type = other RNA
acagcgaacatgcagattc

SEQ ID NO: 3460 - RNA, 19 nt, synthetic construct
  misc_feature 1..19: note = siRNA Sense Sequence
  source 1..19: mol_type = other RNA
aatctgcatgttcgctgtg

SEQ ID NO: 3461 - RNA, 19 nt, synthetic construct
  misc_feature 1..19: note = siRNA Antisense Sequence
  source 1..19: mol_type = other RNA
cacagcgaacatgcagatt

SEQ ID NO: 3462 - RNA, 19 nt, synthetic construct
  misc_feature 1..19: note = siRNA Sense Sequence
  source 1..19: mol_type = other RNA
ttcgctgtgctgagtctgt

SEQ ID NO: 3463 - RNA, 19 nt, synthetic construct
  misc_feature 1..19: note = siRNA Antisense Sequence
  source 1..19: mol_type = other RNA
acagactcagcacagcgaa

SEQ ID NO: 3464 - RNA, 19 nt, synthetic construct
  misc_feature 1..19: note = siRNA Sense Sequence
  source 1..19: mol_type = other RNA
gctgagtctgttgcaggtg

SEQ ID NO: 3465 - RNA, 19 nt, synthetic construct
  misc_feature 1..19: note = siRNA Antisense Sequence
  source 1..19: mol_type = other RNA
cacctgcaacagactcagc

SEQ ID NO: 3466 - RNA, 19 nt, synthetic construct
  misc_feature 1..19: note = siRNA Sense Sequence
  source 1..19: mol_type = other RNA
tgagtctgttgcaggtggg

SEQ ID NO: 3467 - RNA, 19 nt, synthetic construct
  misc_feature 1..19: note = siRNA Antisense Sequence
  source 1..19: mol_type = other RNA
cccacctgcaacagactca

SEQ ID NO: 3468 - RNA, 19 nt, synthetic construct
  misc_feature 1..19: note = siRNA Sense Sequence
  source 1..19: mol_type = other RNA
ggcctgtgcccatttggtg

SEQ ID NO: 3469 - RNA, 19 nt, synthetic construct
  misc_feature 1..19: note = siRNA Antisense Sequence
  source 1..19: mol_type = other RNA
caccaaatgggcacaggcc

SEQ ID NO: 3470 - RNA, 19 nt, synthetic construct
  misc_feature 1..19: note = siRNA Sense Sequence
  source 1..19: mol_type = other RNA
gcctgtgcccatttggtgt

SEQ ID NO: 3471 - RNA, 19 nt, synthetic construct
  misc_feature 1..19: note = siRNA Antisense Sequence
  source 1..19: mol_type = other RNA
acaccaaatgggcacaggc

SEQ ID NO: 3472 - RNA, 19 nt, synthetic construct
  misc_feature 1..19: note = siRNA Sense Sequence
  source 1..19: mol_type = other RNA
cctgtgcccatttggtgtt

SEQ ID NO: 3473 - RNA, 19 nt, synthetic construct
  misc_feature 1..19: note = siRNA Antisense Sequence
  source 1..19: mol_type = other RNA
aacaccaaatgggcacagg

SEQ ID NO: 3474 - RNA, 19 nt, synthetic construct
  misc_feature 1..19: note = siRNA Sense Sequence
  source 1..19: mol_type = other RNA
ctgtgcccatttggtgttg

SEQ ID NO: 3475 - RNA, 19 nt, synthetic construct
  misc_feature 1..19: note = siRNA Antisense Sequence
  source 1..19: mol_type = other RNA
caacaccaaatgggcacag

SEQ ID NO: 3476 - RNA, 19 nt, synthetic construct
  misc_feature 1..19: note = siRNA Sense Sequence
  source 1..19: mol_type = other RNA
gcccatttggtgttgagtc

SEQ ID NO: 3477 - RNA, 19 nt, synthetic construct
  misc_feature 1..19: note = siRNA Antisense Sequence
  source 1..19: mol_type = other RNA
gactcaacaccaaatgggc

SEQ ID NO: 3478 - RNA, 19 nt, synthetic construct
  misc_feature 1..19: note = siRNA Sense Sequence
  source 1..19: mol_type = other RNA
cccatttggtgttgagtcc

SEQ ID NO: 3479 - RNA, 19 nt, synthetic construct
  misc_feature 1..19: note = siRNA Antisense Sequence
  source 1..19: mol_type = other RNA
ggactcaacaccaaatggg

SEQ ID NO: 3480 - RNA, 19 nt, synthetic construct
  misc_feature 1..19: note = siRNA Sense Sequence
  source 1..19: mol_type = other RNA
ccatttggtgttgagtcca

SEQ ID NO: 3481 - RNA, 19 nt, synthetic construct
  misc_feature 1..19: note = siRNA Antisense Sequence
  source 1..19: mol_type = other RNA
tggactcaacaccaaatgg

SEQ ID NO: 3482 - RNA, 19 nt, synthetic construct
  misc_feature 1..19: note = siRNA Sense Sequence
  source 1..19: mol_type = other RNA
catttggtgttgagtccat

SEQ ID NO: 3483 - RNA, 19 nt, synthetic construct
  misc_feature 1..19: note = siRNA Antisense Sequence
  source 1..19: mol_type = other RNA
atggactcaacaccaaatg

SEQ ID NO: 3484 - RNA, 19 nt, synthetic construct
  misc_feature 1..19: note = siRNA Sense Sequence
  source 1..19: mol_type = other RNA
atttggtgttgagtccatc

SEQ ID NO: 3485 - RNA, 19 nt, synthetic construct
  misc_feature 1..19: note = siRNA Antisense Sequence
  source 1..19: mol_type = other RNA
gatggactcaacaccaaat

SEQ ID NO: 3486 - RNA, 19 nt, synthetic construct
  misc_feature 1..19: note = siRNA Sense Sequence
  source 1..19: mol_type = other RNA
tttggtgttgagtccatca

SEQ ID NO: 3487 - RNA, 19 nt, synthetic construct
  misc_feature 1..19: note = siRNA Antisense Sequence
  source 1..19: mol_type = other RNA
tgatggactcaacaccaaa

SEQ ID NO: 3488 - RNA, 19 nt, synthetic construct
  misc_feature 1..19: note = siRNA Sense Sequence
  source 1..19: mol_type = other RNA
ttggtgttgagtccatcat

SEQ ID NO: 3489 - RNA, 19 nt, synthetic construct
  misc_feature 1..19: note = siRNA Antisense Sequence
  source 1..19: mol_type = other RNA
atgatggactcaacaccaa

SEQ ID NO: 3490 - RNA, 19 nt, synthetic construct
  misc_feature 1..19: note = siRNA Sense Sequence
  source 1..19: mol_type = other RNA
tggtgttgagtccatcatg

SEQ ID NO: 3491 - RNA, 19 nt, synthetic construct
  misc_feature 1..19: note = siRNA Antisense Sequence
  source 1..19: mol_type = other RNA
catgatggactcaacacca

SEQ ID NO: 3492 - RNA, 19 nt, synthetic construct
  misc_feature 1..19: note = siRNA Sense Sequence
  source 1..19: mol_type = other RNA
ggtgttgagtccatcatgg

SEQ ID NO: 3493 - RNA, 19 nt, synthetic construct
  misc_feature 1..19: note = siRNA Antisense Sequence
  source 1..19: mol_type = other RNA
ccatgatggactcaacacc

SEQ ID NO: 3494 - RNA, 19 nt, synthetic construct
  misc_feature 1..19: note = siRNA Sense Sequence
  source 1..19: mol_type = other RNA
gtgttgagtccatcatggg

SEQ ID NO: 3495 - RNA, 19 nt, synthetic construct
  misc_feature 1..19: note = siRNA Antisense Sequence
  source 1..19: mol_type = other RNA
cccatgatggactcaacac

SEQ ID NO: 3496 - RNA, 19 nt, synthetic construct
  misc_feature 1..19: note = siRNA Sense Sequence
  source 1..19: mol_type = other RNA
tgttgagtccatcatgggc

SEQ ID NO: 3497 - RNA, 19 nt, synthetic construct
  misc_feature 1..19: note = siRNA Antisense Sequence
  source 1..19: mol_type = other RNA
gcccatgatggactcaaca

SEQ ID NO: 3498 - RNA, 19 nt, synthetic construct
  misc_feature 1..19: note = siRNA Sense Sequence
  source 1..19: mol_type = other RNA
gttgagtccatcatgggct

SEQ ID NO: 3499 - RNA, 19 nt, synthetic construct
  misc_feature 1..19: note = siRNA Antisense Sequence
  source 1..19: mol_type = other RNA
agcccatgatggactcaac

SEQ ID NO: 3500 - RNA, 19 nt, synthetic construct
  misc_feature 1..19: note = siRNA Sense Sequence
  source 1..19: mol_type = other RNA
ttgagtccatcatgggctt

SEQ ID NO: 3501 - RNA, 19 nt, synthetic construct
  misc_feature 1..19: note = siRNA Antisense Sequence
  source 1..19: mol_type = other RNA
aagcccatgatggactcaa

SEQ ID NO: 3502 - RNA, 19 nt, synthetic construct
  misc_feature 1..19: note = siRNA Sense Sequence
  source 1..19: mol_type = other RNA
tgagtccatcatgggcttt

SEQ ID NO: 3503 - RNA, 19 nt, synthetic construct
  misc_feature 1..19: note = siRNA Antisense Sequence
  source 1..19: mol_type = other RNA
aaagcccatgatggactca

SEQ ID NO: 3504 - RNA, 19 nt, synthetic construct
  misc_feature 1..19: note = siRNA Sense Sequence
  source 1..19: mol_type = other RNA
ccatcatgggctttatgtg

SEQ ID NO: 3505 - RNA, 19 nt, synthetic construct
  misc_feature 1..19: note = siRNA Antisense Sequence
  source 1..19: mol_type = other RNA
cacataaagcccatgatgg

SEQ ID NO: 3506 - RNA, 19 nt, synthetic construct
  misc_feature 1..19: note = siRNA Sense Sequence
  source 1..19: mol_type = other RNA
catcatgggctttatgtgg

SEQ ID NO: 3507 - RNA, 19 nt, synthetic construct
  misc_feature 1..19: note = siRNA Antisense Sequence
  source 1..19: mol_type = other RNA
ccacataaagcccatgatg

SEQ ID NO: 3508 - RNA, 19 nt, synthetic construct
  misc_feature 1..19: note = siRNA Sense Sequence
  source 1..19: mol_type = other RNA
atgggctttatgtggttag

SEQ ID NO: 3509 - RNA, 19 nt, synthetic construct
  misc_feature 1..19: note = siRNA Antisense Sequence
  source 1..19: mol_type = other RNA
ctaaccacataaagcccat

SEQ ID NO: 3510 - RNA, 19 nt, synthetic construct
  misc_feature 1..19: note = siRNA Sense Sequence
  source 1..19: mol_type = other RNA
tgggctttatgtggttagt

SEQ ID NO: 3511 - RNA, 19 nt, synthetic construct
  misc_feature 1..19: note = siRNA Antisense Sequence
  source 1..19: mol_type = other RNA
actaaccacataaagccca

SEQ ID NO: 3512 - RNA, 19 nt, synthetic construct
  misc_feature 1..19: note = siRNA Sense Sequence
  source 1..19: mol_type = other RNA
gggctttatgtggttagtc

SEQ ID NO: 3513 - RNA, 19 nt, synthetic construct
  misc_feature 1..19: note = siRNA Antisense Sequence
  source 1..19: mol_type = other RNA
gactaaccacataaagccc

SEQ ID NO: 3514 - RNA, 19 nt, synthetic construct
  misc_feature 1..19: note = siRNA Sense Sequence
  source 1..19: mol_type = other RNA
ggctttatgtggttagtcc

SEQ ID NO: 3515 - RNA, 19 nt, synthetic construct
  misc_feature 1..19: note = siRNA Antisense Sequence
  source 1..19: mol_type = other RNA
ggactaaccacataaagcc

SEQ ID NO: 3516 - RNA, 19 nt, synthetic construct
  misc_feature 1..19: note = siRNA Sense Sequence
  source 1..19: mol_type = other RNA
gctttatgtggttagtcct

SEQ ID NO: 3517 - RNA, 19 nt, synthetic construct
  misc_feature 1..19: note = siRNA Antisense Sequence
  source 1..19: mol_type = other RNA
aggactaaccacataaagc

SEQ ID NO: 3518 - RNA, 19 nt, synthetic construct
  misc_feature 1..19: note = siRNA Sense Sequence
  source 1..19: mol_type = other RNA
ctttatgtggttagtcctc

SEQ ID NO: 3519 - RNA, 19 nt, synthetic construct
  misc_feature 1..19: note = siRNA Antisense Sequence
  source 1..19: mol_type = other RNA
gaggactaaccacataaag

SEQ ID NO: 3520 - RNA, 19 nt, synthetic construct
  misc_feature 1..19: note = siRNA Sense Sequence
  source 1..19: mol_type = other RNA
gtggttagtcctcagctgg

SEQ ID NO: 3521 - RNA, 19 nt, synthetic construct
  misc_feature 1..19: note = siRNA Antisense Sequence
  source 1..19: mol_type = other RNA
ccagctgaggactaaccac

SEQ ID NO: 3522 - RNA, 19 nt, synthetic construct
  misc_feature 1..19: note = siRNA Sense Sequence
  source 1..19: mol_type = other RNA
tggttagtcctcagctggg

SEQ ID NO: 3523 - RNA, 19 nt, synthetic construct
  misc_feature 1..19: note = siRNA Antisense Sequence
  source 1..19: mol_type = other RNA
cccagctgaggactaacca

SEQ ID NO: 3524 - RNA, 19 nt, synthetic construct
  misc_feature 1..19: note = siRNA Sense Sequence
  source 1..19: mol_type = other RNA
ggttagtcctcagctgggt

SEQ ID NO: 3525 - RNA, 19 nt, synthetic construct
  misc_feature 1..19: note = siRNA Antisense Sequence
  source 1..19: mol_type = other RNA
acccagctgaggactaacc

SEQ ID NO: 3526 - RNA, 19 nt, synthetic construct
  misc_feature 1..19: note = siRNA Sense Sequence
  source 1..19: mol_type = other RNA
gttagtcctcagctgggtc

SEQ ID NO: 3527 - RNA, 19 nt, synthetic construct
  misc_feature 1..19: note = siRNA Antisense Sequence
  source 1..19: mol_type = other RNA
gacccagctgaggactaac

SEQ ID NO: 3528 - RNA, 19 nt, synthetic construct
  misc_feature 1..19: note = siRNA Sense Sequence
  source 1..19: mol_type = other RNA
ttagtcctcagctgggtca

SEQ ID NO: 3529 - RNA, 19 nt, synthetic construct
  misc_feature 1..19: note = siRNA Antisense Sequence
  source 1..19: mol_type = other RNA
tgacccagctgaggactaa

SEQ ID NO: 3530 - RNA, 19 nt, synthetic construct
  misc_feature 1..19: note = siRNA Sense Sequence
  source 1..19: mol_type = other RNA
tagtcctcagctgggtcac

SEQ ID NO: 3531 - RNA, 19 nt, synthetic construct
  misc_feature 1..19: note = siRNA Antisense Sequence
  source 1..19: mol_type = other RNA
gtgacccagctgaggacta

SEQ ID NO: 3532 - RNA, 19 nt, synthetic construct
  misc_feature 1..19: note = siRNA Sense Sequence
  source 1..19: mol_type = other RNA
gtcctcagctgggtcacct

SEQ ID NO: 3533 - RNA, 19 nt, synthetic construct
  misc_feature 1..19: note = siRNA Antisense Sequence
  source 1..19: mol_type = other RNA
aggtgacccagctgaggac

SEQ ID NO: 3534 - RNA, 19 nt, synthetic construct
  misc_feature 1..19: note = siRNA Sense Sequence
  source 1..19: mol_type = other RNA
cagctgggtcaccttcact

SEQ ID NO: 3535 - RNA, 19 nt, synthetic construct
  misc_feature 1..19: note = siRNA Antisense Sequence
  source 1..19: mol_type = other RNA
agtgaaggtgacccagctg

SEQ ID NO: 3536 - RNA, 19 nt, synthetic construct
  misc_feature 1..19: note = siRNA Sense Sequence
  source 1..19: mol_type = other RNA
ctgggtcaccttcactgct

SEQ ID NO: 3537 - RNA, 19 nt, synthetic construct
  misc_feature 1..19: note = siRNA Antisense Sequence
  source 1..19: mol_type = other RNA
agcagtgaaggtgacccag

SEQ ID NO: 3538 - RNA, 19 nt, synthetic construct
  misc_feature 1..19: note = siRNA Sense Sequence
  source 1..19: mol_type = other RNA
gggtcaccttcactgctcc

SEQ ID NO: 3539 - RNA, 19 nt, synthetic construct
  misc_feature 1..19: note = siRNA Antisense Sequence
  source 1..19: mol_type = other RNA
ggagcagtgaaggtgaccc

SEQ ID NO: 3540 - RNA, 19 nt, synthetic construct
  misc_feature 1..19: note = siRNA Sense Sequence
  source 1..19: mol_type = other RNA
ttcactgctccattgtcct

SEQ ID NO: 3541 - RNA, 19 nt, synthetic construct
  misc_feature 1..19: note = siRNA Antisense Sequence
  source 1..19: mol_type = other RNA
aggacaatggagcagtgaa

SEQ ID NO: 3542 - RNA, 19 nt, synthetic construct
  misc_feature 1..19: note = siRNA Sense Sequence
  source 1..19: mol_type = other RNA
tgctccattgtccttgtcc

SEQ ID NO: 3543 - RNA, 19 nt, synthetic construct
  misc_feature 1..19: note = siRNA Antisense Sequence
  source 1..19: mol_type = other RNA
ggacaaggacaatggagca

SEQ ID NO: 3544 - RNA, 19 nt, synthetic construct
  misc_feature 1..19: note = siRNA Sense Sequence
  source 1..19: mol_type = other RNA
ctccattgtccttgtccct

SEQ ID NO: 3545 - RNA, 19 nt, synthetic construct
  misc_feature 1..19: note = siRNA Antisense Sequence
  source 1..19: mol_type = other RNA
agggacaaggacaatggag

SEQ ID NO: 3546 - RNA, 19 nt, synthetic construct
  misc_feature 1..19: note = siRNA Sense Sequence
  source 1..19: mol_type = other RNA
cattgtccttgtcccttca

SEQ ID NO: 3547 - RNA, 19 nt, synthetic construct
  misc_feature 1..19: note = siRNA Antisense Sequence
  source 1..19: mol_type = other RNA
tgaagggacaaggacaatg

SEQ ID NO: 3548 - RNA, 19 nt, synthetic construct
  misc_feature 1..19: note = siRNA Sense Sequence
  source 1..19: mol_type = other RNA
ttgtccttgtcccttcagt

SEQ ID NO: 3549 - RNA, 19 nt, synthetic construct
  misc_feature 1..19: note = siRNA Antisense Sequence
  source 1..19: mol_type = other RNA
actgaagggacaaggacaa

SEQ ID NO: 3550 - RNA, 19 nt, synthetic construct
  misc_feature 1..19: note = siRNA Sense Sequence
  source 1..19: mol_type = other RNA
tccttgtcccttcagtgga

SEQ ID NO: 3551 - RNA, 19 nt, synthetic construct
  misc_feature 1..19: note = siRNA Antisense Sequence
  source 1..19: mol_type = other RNA
tccactgaagggacaagga

SEQ ID NO: 3552 - RNA, 19 nt, synthetic construct
  misc_feature 1..19: note = siRNA Sense Sequence
  source 1..19: mol_type = other RNA
aacttgtccagcgggagct

SEQ ID NO: 3553 - RNA, 19 nt, synthetic construct
  misc_feature 1..19: note = siRNA Antisense Sequence
  source 1..19: mol_type = other RNA
agctcccgctggacaagtt

SEQ ID NO: 3554 - RNA, 19 nt, synthetic construct
  misc_feature 1..19: note = siRNA Sense Sequence
  source 1..19: mol_type = other RNA
agcgggagctgtgaccaca

SEQ ID NO: 3555 - RNA, 19 nt, synthetic construct
  misc_feature 1..19: note = siRNA Antisense Sequence
  source 1..19: mol_type = other RNA
tgtggtcacagctcccgct

SEQ ID NO: 3556 - RNA, 19 nt, synthetic construct
  misc_feature 1..19: note = siRNA Sense Sequence
  source 1..19: mol_type = other RNA
tgaccacagaggctcacac

SEQ ID NO: 3557 - RNA, 19 nt, synthetic construct
  misc_feature 1..19: note = siRNA Antisense Sequence
  source 1..19: mol_type = other RNA
gtgtgagcctctgtggtca

SEQ ID NO: 3558 - RNA, 19 nt, synthetic construct
  misc_feature 1..19: note = siRNA Sense Sequence
  source 1..19: mol_type = other RNA
aaattttcagagccattca

SEQ ID NO: 3559 - RNA, 19 nt, synthetic construct
  misc_feature 1..19: note = siRNA Antisense Sequence
  source 1..19: mol_type = other RNA
tgaatggctctgaaaattt

SEQ ID NO: 3560 - RNA, 19 nt, synthetic construct
  misc_feature 1..19: note = siRNA Sense Sequence
  source 1..19: mol_type = other RNA
ccattcacctcttgccctg

SEQ ID NO: 3561 - RNA, 19 nt, synthetic construct
  misc_feature 1..19: note = siRNA Antisense Sequence
  source 1..19: mol_type = other RNA
cagggcaagaggtgaatgg

SEQ ID NO: 3562 - RNA, 19 nt, synthetic construct
  misc_feature 1..19: note = siRNA Sense Sequence
  source 1..19: mol_type = other RNA
tcacctcttgccctgcttc

SEQ ID NO: 3563 - RNA, 19 nt, synthetic construct
  misc_feature 1..19: note = siRNA Antisense Sequence
  source 1..19: mol_type = other RNA
gaagcagggcaagaggtga

SEQ ID NO: 3564 - RNA, 19 nt, synthetic construct
  misc_feature 1..19: note = siRNA Sense Sequence
  source 1..19: mol_type = other RNA
cacctcttgccctgcttct

SEQ ID NO: 3565 - RNA, 19 nt, synthetic construct
  misc_feature 1..19: note = siRNA Antisense Sequence
  source 1..19: mol_type = other RNA
agaagcagggcaagaggtg

SEQ ID NO: 3566 - RNA, 19 nt, synthetic construct
  misc_feature 1..19: note = siRNA Sense Sequence
  source 1..19: mol_type = other RNA
acctcttgccctgcttcta

SEQ ID NO: 3567 - RNA, 19 nt, synthetic construct
  misc_feature 1..19: note = siRNA Antisense Sequence
  source 1..19: mol_type = other RNA
tagaagcagggcaagaggt

SEQ ID NO: 3568 - RNA, 19 nt, synthetic construct
  misc_feature 1..19: note = siRNA Sense Sequence
  source 1..19: mol_type = other RNA
cctcttgccctgcttctag

SEQ ID NO: 3569 - RNA, 19 nt, synthetic construct
  misc_feature 1..19: note = siRNA Antisense Sequence
  source 1..19: mol_type = other RNA
ctagaagcagggcaagagg

SEQ ID NO: 3570 - RNA, 19 nt, synthetic construct
  misc_feature 1..19: note = siRNA Sense Sequence
  source 1..19: mol_type = other RNA
ctcttgccctgcttctaga

SEQ ID NO: 3571 - RNA, 19 nt, synthetic construct
  misc_feature 1..19: note = siRNA Antisense Sequence
  source 1..19: mol_type = other RNA
tctagaagcagggcaagag

SEQ ID NO: 3572 - RNA, 19 nt, synthetic construct
  misc_feature 1..19: note = siRNA Sense Sequence
  source 1..19: mol_type = other RNA
tcttgccctgcttctagag

SEQ ID NO: 3573 - RNA, 19 nt, synthetic construct
  misc_feature 1..19: note = siRNA Antisense Sequence
  source 1..19: mol_type = other RNA
ctctagaagcagggcaaga

SEQ ID NO: 3574 - RNA, 19 nt, synthetic construct
  misc_feature 1..19: note = siRNA Sense Sequence
  source 1..19: mol_type = other RNA
cttgccctgcttctagagc

SEQ ID NO: 3575 - RNA, 19 nt, synthetic construct
  misc_feature 1..19: note = siRNA Antisense Sequence
  source 1..19: mol_type = other RNA
gctctagaagcagggcaag

SEQ ID NO: 3576 - RNA, 19 nt, synthetic construct
  misc_feature 1..19: note = siRNA Sense Sequence
  source 1..19: mol_type = other RNA
ttgccctgcttctagagct

SEQ ID NO: 3577 - RNA, 19 nt, synthetic construct
  misc_feature 1..19: note = siRNA Antisense Sequence
  source 1..19: mol_type = other RNA
agctctagaagcagggcaa

SEQ ID NO: 3578 - RNA, 19 nt, synthetic construct
  misc_feature 1..19: note = siRNA Sense Sequence
  source 1..19: mol_type = other RNA
tgccctgcttctagagctc

SEQ ID NO: 3579 - RNA, 19 nt, synthetic construct
  misc_feature 1..19: note = siRNA Antisense Sequence
  source 1..19: mol_type = other RNA
gagctctagaagcagggca

SEQ ID NO: 3580 - RNA, 19 nt, synthetic construct
  misc_feature 1..19: note = siRNA Sense Sequence
  source 1..19: mol_type = other RNA
gccctgcttctagagctcc

SEQ ID NO: 3581 - RNA, 19 nt, synthetic construct
  misc_feature 1..19: note = siRNA Antisense Sequence
  source 1..19: mol_type = other RNA
ggagctctagaagcagggc

SEQ ID NO: 3582 - RNA, 19 nt, synthetic construct
  misc_feature 1..19: note = siRNA Sense Sequence
  source 1..19: mol_type = other RNA
tgcttctagagctcctttt

SEQ ID NO: 3583 - RNA, 19 nt, synthetic construct
  misc_feature 1..19: note = siRNA Antisense Sequence
  source 1..19: mol_type = other RNA
aaaaggagctctagaagca

SEQ ID NO: 3584 - RNA, 19 nt, synthetic construct
  misc_feature 1..19: note = siRNA Sense Sequence
  source 1..19: mol_type = other RNA
gcttctagagctccttttc

SEQ ID NO: 3585 - RNA, 19 nt, synthetic construct
  misc_feature 1..19: note = siRNA Antisense Sequence
  source 1..19: mol_type = other RNA
gaaaaggagctctagaagc

SEQ ID NO: 3586 - RNA, 19 nt, synthetic construct
  misc_feature 1..19: note = siRNA Sense Sequence
  source 1..19: mol_type = other RNA
cttctagagctccttttct

SEQ ID NO: 3587 - RNA, 19 nt, synthetic construct
  misc_feature 1..19: note = siRNA Antisense Sequence
  source 1..19: mol_type = other RNA
agaaaaggagctctagaag

SEQ ID NO: 3588 - RNA, 19 nt, synthetic construct
  misc_feature 1..19: note = siRNA Sense Sequence
  source 1..19: mol_type = other RNA
ttctagagctccttttctg

SEQ ID NO: 3589 - RNA, 19 nt, synthetic construct
  misc_feature 1..19: note = siRNA Antisense Sequence
  source 1..19: mol_type = other RNA
cagaaaaggagctctagaa

SEQ ID NO: 3590 - RNA, 19 nt, synthetic construct
  misc_feature 1..19: note = siRNA Sense Sequence
  source 1..19: mol_type = other RNA
ctagagctccttttctgct

SEQ ID NO: 3591 - RNA, 19 nt, synthetic construct
  misc_feature 1..19: note = siRNA Antisense Sequence
  source 1..19: mol_type = other RNA
agcagaaaaggagctctag

SEQ ID NO: 3592 - RNA, 19 nt, synthetic construct
  misc_feature 1..19: note = siRNA Sense Sequence
  source 1..19: mol_type = other RNA
ccttttctgctctgctctc

SEQ ID NO: 3593 - RNA, 19 nt, synthetic construct
  misc_feature 1..19: note = siRNA Antisense Sequence
  source 1..19: mol_type = other RNA
gagagcagagcagaaaagg

SEQ ID NO: 3594 - RNA, 19 nt, synthetic construct
  misc_feature 1..19: note = siRNA Sense Sequence
  source 1..19: mol_type = other RNA
ttctgctctgctctcctgc

SEQ ID NO: 3595 - RNA, 19 nt, synthetic construct
  misc_feature 1..19: note = siRNA Antisense Sequence
  source 1..19: mol_type = other RNA
gcaggagagcagagcagaa

SEQ ID NO: 3596 - RNA, 19 nt, synthetic construct
  misc_feature 1..19: note = siRNA Sense Sequence
  source 1..19: mol_type = other RNA
tctgctctgctctcctgcc

SEQ ID NO: 3597 - RNA, 19 nt, synthetic construct
  misc_feature 1..19: note = siRNA Antisense Sequence
  source 1..19: mol_type = other RNA
ggcaggagagcagagcaga

SEQ ID NO: 3598 - RNA, 19 nt, synthetic construct
  misc_feature 1..19: note = siRNA Sense Sequence
  source 1..19: mol_type = other RNA
tgctctgctctcctgccct

SEQ ID NO: 3599 - RNA, 19 nt, synthetic construct
  misc_feature 1..19: note = siRNA Antisense Sequence
  source 1..19: mol_type = other RNA
agggcaggagagcagagca

SEQ ID NO: 3600 - RNA, 19 nt, synthetic construct
  misc_feature 1..19: note = siRNA Sense Sequence
  source 1..19: mol_type = other RNA
ctctgctctcctgccctct

SEQ ID NO: 3601 - RNA, 19 nt, synthetic construct
  misc_feature 1..19: note = siRNA Antisense Sequence
  source 1..19: mol_type = other RNA
agagggcaggagagcagag

SEQ ID NO: 3602 - RNA, 19 nt, synthetic construct
  misc_feature 1..19: note = siRNA Sense Sequence
  source 1..19: mol_type = other RNA
tctgctctcctgccctctc

SEQ ID NO: 3603 - RNA, 19 nt, synthetic construct
  misc_feature 1..19: note = siRNA Antisense Sequence
  source 1..19: mol_type = other RNA
gagagggcaggagagcaga

SEQ ID NO: 3604 - RNA, 19 nt, synthetic construct
  misc_feature 1..19: note = siRNA Sense Sequence
  source 1..19: mol_type = other RNA
ctgctctcctgccctctct

SEQ ID NO: 3605 - RNA, 19 nt, synthetic construct
  misc_feature 1..19: note = siRNA Antisense Sequence
  source 1..19: mol_type = other RNA
agagagggcaggagagcag

SEQ ID NO: 3606 - RNA, 19 nt, synthetic construct
  misc_feature 1..19: note = siRNA Sense Sequence
  source 1..19: mol_type = other RNA
tctccctgccctggttcta

SEQ ID NO: 3607 - RNA, 19 nt, synthetic construct
  misc_feature 1..19: note = siRNA Antisense Sequence
  source 1..19: mol_type = other RNA
tagaaccagggcagggaga

SEQ ID NO: 3608 - RNA, 19 nt, synthetic construct
  misc_feature 1..19: note = siRNA Sense Sequence
  source 1..19: mol_type = other RNA
ccctggttctagtgatctt

SEQ ID NO: 3609 - RNA, 19 nt, synthetic construct
  misc_feature 1..19: note = siRNA Antisense Sequence
  source 1..19: mol_type = other RNA
aagatcactagaaccaggg

SEQ ID NO: 3610 - RNA, 19 nt, synthetic construct
  misc_feature 1..19: note = siRNA Sense Sequence
  source 1..19: mol_type = other RNA
cctggttctagtgatcttg

SEQ ID NO: 3611 - RNA, 19 nt, synthetic construct
  misc_feature 1..19: note = siRNA Antisense Sequence
  source 1..19: mol_type = other RNA
caagatcactagaaccagg

SEQ ID NO: 3612 - RNA, 19 nt, synthetic construct
  misc_feature 1..19: note = siRNA Sense Sequence
  source 1..19: mol_type = other RNA
ctggttctagtgatcttgg

SEQ ID NO: 3613 - RNA, 19 nt, synthetic construct
  misc_feature 1..19: note = siRNA Antisense Sequence
  source 1..19: mol_type = other RNA
ccaagatcactagaaccag

SEQ ID NO: 3614 - RNA, 19 nt, synthetic construct
  misc_feature 1..19: note = siRNA Sense Sequence
  source 1..19: mol_type = other RNA
tggttctagtgatcttggt

SEQ ID NO: 3615 - RNA, 19 nt, synthetic construct
  misc_feature 1..19: note = siRNA Antisense Sequence
  source 1..19: mol_type = other RNA
accaagatcactagaacca

SEQ ID NO: 3616 - RNA, 19 nt, synthetic construct
  misc_feature 1..19: note = siRNA Sense Sequence
  source 1..19: mol_type = other RNA
ggttctagtgatcttggtg

SEQ ID NO: 3617 - RNA, 19 nt, synthetic construct
  misc_feature 1..19: note = siRNA Antisense Sequence
  source 1..19: mol_type = other RNA
caccaagatcactagaacc

SEQ ID NO: 3618 - RNA, 19 nt, synthetic construct
  misc_feature 1..19: note = siRNA Sense Sequence
  source 1..19: mol_type = other RNA
gatcttggtgctgaatcca

SEQ ID NO: 3619 - RNA, 19 nt, synthetic construct
  misc_feature 1..19: note = siRNA Antisense Sequence
  source 1..19: mol_type = other RNA
tggattcagcaccaagatc

SEQ ID NO: 3620 - RNA, 19 nt, synthetic construct
  misc_feature 1..19: note = siRNA Sense Sequence
  source 1..19: mol_type = other RNA
tggtgctgaatccaatccc

SEQ ID NO: 3621 - RNA, 19 nt, synthetic construct
  misc_feature 1..19: note = siRNA Antisense Sequence
  source 1..19: mol_type = other RNA
gggattggattcagcacca

SEQ ID NO: 3622 - RNA, 19 nt, synthetic construct
  misc_feature 1..19: note = siRNA Sense Sequence
  source 1..19: mol_type = other RNA
gctgaatccaatcccaact

SEQ ID NO: 3623 - RNA, 19 nt, synthetic construct
  misc_feature 1..19: note = siRNA Antisense Sequence
  source 1..19: mol_type = other RNA
agttgggattggattcagc

SEQ ID NO: 3624 - RNA, 19 nt, synthetic construct
  misc_feature 1..19: note = siRNA Sense Sequence
  source 1..19: mol_type = other RNA
aatccaatcccaactcatg

SEQ ID NO: 3625 - RNA, 19 nt, synthetic construct
  misc_feature 1..19: note = siRNA Antisense Sequence
  source 1..19: mol_type = other RNA
catgagttgggattggatt

SEQ ID NO: 3626 - RNA, 19 nt, synthetic construct
  misc_feature 1..19: note = siRNA Sense Sequence
  source 1..19: mol_type = other RNA
atcccaactcatgaatctg

SEQ ID NO: 3627 - RNA, 19 nt, synthetic construct
  misc_feature 1..19: note = siRNA Antisense Sequence
  source 1..19: mol_type = other RNA
cagattcatgagttgggat

SEQ ID NO: 3628 - RNA, 19 nt, synthetic construct
  misc_feature 1..19: note = siRNA Sense Sequence
  source 1..19: mol_type = other RNA
tcccaactcatgaatctgt

SEQ ID NO: 3629 - RNA, 19 nt, synthetic construct
  misc_feature 1..19: note = siRNA Antisense Sequence
  source 1..19: mol_type = other RNA
acagattcatgagttggga

SEQ ID NO: 3630 - RNA, 19 nt, synthetic construct
  misc_feature 1..19: note = siRNA Sense Sequence
  source 1..19: mol_type = other RNA
cccaactcatgaatctgta

SEQ ID NO: 3631 - RNA, 19 nt, synthetic construct
  misc_feature 1..19: note = siRNA Antisense Sequence
  source 1..19: mol_type = other RNA
tacagattcatgagttggg

SEQ ID NO: 3632 - RNA, 19 nt, synthetic construct
  misc_feature 1..19: note = siRNA Sense Sequence
  source 1..19: mol_type = other RNA
ccaactcatgaatctgtaa

SEQ ID NO: 3633 - RNA, 19 nt, synthetic construct
  misc_feature 1..19: note = siRNA Antisense Sequence
  source 1..19: mol_type = other RNA
ttacagattcatgagttgg

SEQ ID NO: 3634 - RNA, 19 nt, synthetic construct
  misc_feature 1..19: note = siRNA Sense Sequence
  source 1..19: mol_type = other RNA
caactcatgaatctgtaaa

SEQ ID NO: 3635 - RNA, 19 nt, synthetic construct
  misc_feature 1..19: note = siRNA Antisense Sequence
  source 1..19: mol_type = other RNA
tttacagattcatgagttg

SEQ ID NO: 3636 - RNA, 19 nt, synthetic construct
  misc_feature 1..19: note = siRNA Sense Sequence
  source 1..19: mol_type = other RNA
actcatgaatctgtaaagc

SEQ ID NO: 3637 - RNA, 19 nt, synthetic construct
  misc_feature 1..19: note = siRNA Antisense Sequence
  source 1..19: mol_type = other RNA
gctttacagattcatgagt

SEQ ID NO: 3638 - RNA, 19 nt, synthetic construct
  misc_feature 1..19: note = siRNA Sense Sequence
  source 1..19: mol_type = other RNA
ctcatgaatctgtaaagca

SEQ ID NO: 3639 - RNA, 19 nt, synthetic construct
  misc_feature 1..19: note = siRNA Antisense Sequence
  source 1..19: mol_type = other RNA
tgctttacagattcatgag

SEQ ID NO: 3640 - RNA, 19 nt, synthetic construct
  misc_feature 1..19: note = siRNA Sense Sequence
  source 1..19: mol_type = other RNA
tcatgaatctgtaaagcag

SEQ ID NO: 3641 - RNA, 19 nt, synthetic construct
  misc_feature 1..19: note = siRNA Antisense Sequence
  source 1..19: mol_type = other RNA
ctgctttacagattcatga

SEQ ID NO: 3642 - RNA, 19 nt, synthetic construct
  misc_feature 1..19: note = siRNA Sense Sequence
  source 1..19: mol_type = other RNA
gtaaagcagagtctaattt

SEQ ID NO: 3643 - RNA, 19 nt, synthetic construct
  misc_feature 1..19: note = siRNA Antisense Sequence
  source 1..19: mol_type = other RNA
aaattagactctgctttac

SEQ ID NO: 3644 - RNA, 19 nt, synthetic construct
  misc_feature 1..19: note = siRNA Sense Sequence
  source 1..19: mol_type = other RNA
aaattggacccgtcatcaa

SEQ ID NO: 3645 - RNA, 19 nt, synthetic construct
  misc_feature 1..19: note = siRNA Antisense Sequence
  source 1..19: mol_type = other RNA
ttgatgacgggtccaattt

SEQ ID NO: 3646 - RNA, 19 nt, synthetic construct
  misc_feature 1..19: note = siRNA Sense Sequence
  source 1..19: mol_type = other RNA
aattggacccgtcatcaag

SEQ ID NO: 3647 - RNA, 19 nt, synthetic construct
  misc_feature 1..19: note = siRNA Antisense Sequence
  source 1..19: mol_type = other RNA
cttgatgacgggtccaatt

SEQ ID NO: 3648 - RNA, 19 nt, synthetic construct
  misc_feature 1..19: note = siRNA Sense Sequence
  source 1..19: mol_type = other RNA
attggacccgtcatcaagg

SEQ ID NO: 3649 - RNA, 19 nt, synthetic construct
  misc_feature 1..19: note = siRNA Antisense Sequence
  source 1..19: mol_type = other RNA
ccttgatgacgggtccaat

SEQ ID NO: 3650 - RNA, 19 nt, synthetic construct
  misc_feature 1..19: note = siRNA Sense Sequence
  source 1..19: mol_type = other RNA
ttggacccgtcatcaagga

SEQ ID NO: 3651 - RNA, 19 nt, synthetic construct
  misc_feature 1..19: note = siRNA Antisense Sequence
  source 1..19: mol_type = other RNA
tccttgatgacgggtccaa

SEQ ID NO: 3652 - RNA, 19 nt, synthetic construct
  misc_feature 1..19: note = siRNA Sense Sequence
  source 1..19: mol_type = other RNA
tggacccgtcatcaaggac

SEQ ID NO: 3653 - RNA, 19 nt, synthetic construct
  misc_feature 1..19: note = siRNA Antisense Sequence
  source 1..19: mol_type = other RNA
gtccttgatgacgggtcca

SEQ ID NO: 3654 - RNA, 19 nt, synthetic construct
  misc_feature 1..19: note = siRNA Sense Sequence
  source 1..19: mol_type = other RNA
ggacccgtcatcaaggact

SEQ ID NO: 3655 - RNA, 19 nt, synthetic construct
  misc_feature 1..19: note = siRNA Antisense Sequence
  source 1..19: mol_type = other RNA
agtccttgatgacgggtcc

SEQ ID NO: 3656 - RNA, 19 nt, synthetic construct
  misc_feature 1..19: note = siRNA Sense Sequence
  source 1..19: mol_type = other RNA
gtcatcaaggactgttctt

SEQ ID NO: 3657 - RNA, 19 nt, synthetic construct
  misc_feature 1..19: note = siRNA Antisense Sequence
  source 1..19: mol_type = other RNA
aagaacagtccttgatgac

SEQ ID NO: 3658 - RNA, 19 nt, synthetic construct
  misc_feature 1..19: note = siRNA Sense Sequence
  source 1..19: mol_type = other RNA
ggactgttctttcctgaag

SEQ ID NO: 3659 - RNA, 19 nt, synthetic construct
  misc_feature 1..19: note = siRNA Antisense Sequence
  source 1..19: mol_type = other RNA
cttcaggaaagaacagtcc

SEQ ID NO: 3660 - RNA, 19 nt, synthetic construct
  misc_feature 1..19: note = siRNA Sense Sequence
  source 1..19: mol_type = other RNA
attgtgtgctgcagtgtgc

SEQ ID NO: 3661 - RNA, 19 nt, synthetic construct
  misc_feature 1..19: note = siRNA Antisense Sequence
  source 1..19: mol_type = other RNA
gcacactgcagcacacaat

What is claimed is:

1. A method of treating a human subject with a therapeutic agent that treats or inhibits uveitis, wherein the human subject has uveitis, the method comprising the steps of:
   determining whether the human subject has an Endoplasmic Reticulum Aminopeptidase 1 (ERAP1) variant nucleic acid molecule encoding Lys528Arg or Asp575Asn by:
      obtaining or having obtained a biological sample from the human subject;
      performing or having performed a sequence analysis on the biological sample to determine if the human subject has a genotype comprising the ERAP1 variant nucleic acid molecule; and
      detecting the presence or absence of HLA-B27 in the biological sample; and
   administering or continuing to administer to the human subject the therapeutic agent that treats or inhibits uveitis in a standard dosage amount to a human subject that is ERAP1 reference and is HLA-B27 positive, and/or administering to the human subject an antisense nucleic acid molecule or a small interfering RNA (siRNA) that hybridizes to an Endoplasmic Reticulum Aminopeptidase 1 (ERAP1) nucleic acid molecule; or
   administering or continuing to administer to the human subject the therapeutic agent that treats or inhibits uveitis in an amount that is the same as or less than a standard dosage amount to a human subject that is heterozygous for the ERAP1 variant nucleic acid molecule and is HLA-B27 positive, and/or administering to the human subject an antisense nucleic acid molecule or a small interfering RNA (siRNA) that hybridizes to an Endoplasmic Reticulum Aminopeptidase 1 (ERAP1) nucleic acid molecule;
   wherein the presence of a genotype having the ERAP1 variant nucleic acid molecule encoding Lys528Arg or Asp575Asn indicates the human subject has a decreased risk of developing uveitis.

2. The method according to claim 1, wherein the uveitis comprises anterior uveitis, acute anterior uveitis, or pan-uveitis.

3. The method according to claim 2, wherein the acute anterior uveitis comprises iridocyclitis or iritis.

4. The method according to claim 1, wherein the ERAP1 variant nucleic acid molecule is:
   a genomic nucleic acid molecule having a nucleotide sequence comprising: a guanine at a position corresponding to position 19,474 according to SEQ ID NO:2, an adenine at a position corresponding to position 21,595 according to SEQ ID NO:3, a cytosine at a position corresponding to position 21,811 according to SEQ ID NO:4, or a thymine at a position corresponding to position 42,579 according to SEQ ID NO:5;
   an mRNA molecule having a nucleotide sequence comprising: a guanine at a position corresponding to position 1,841 according to SEQ ID NO:7, or an adenine at a position corresponding to position 1,981 according to SEQ ID NO:8; or
   a cDNA molecule produced from an mRNA molecule, wherein the cDNA molecule has a nucleotide sequence comprising: a guanine at a position corresponding to position 1,841 according to SEQ ID NO:10, or an adenine at a position corresponding to position 1,981 according to SEQ ID NO:11.

5. The method according to claim 1, wherein the antisense nucleic acid molecule comprises a nucleotide sequence selected from the group consisting of SEQ ID NOs: 35-784, and wherein the siRNA molecule comprises a sense strand and a corresponding antisense strand selected from the group consisting of SEQ ID NOs: 785-2578.

6. The method according to claim 1, the method further comprising administering to the subject an HLA-B27 inhibitor selected from an HLA-B27 antibody, an HLA-B27 antisense nucleic acid molecule, or an HLA-B27 siRNA molecule.

7. The method according to claim 6, wherein the HLA-B27 inhibitor comprises an HLA-B27 antibody.

8. The method according to claim 6, wherein the HLA-B27 antisense nucleic acid molecule comprises a nucleotide sequence selected from the group consisting of SEQ ID NOS: 2579-2923.

9. The method according to claim 6, wherein the HLA-B27 siRNA molecule comprises a sense strand and a corresponding antisense strand selected from the group consisting of SEQ ID NOs: 2924-3661.

\* \* \* \* \*